(12) United States Patent
Pharkya et al.

(10) Patent No.: US 12,312,627 B2
(45) Date of Patent: May 27, 2025

(54) MICROORGANISMS AND METHODS FOR PRODUCTION OF 4-HYDROXYBUTYRATE, 1,4-BUTANEDIOL AND RELATED COMPOUNDS

(71) Applicant: Genomatica, Inc., San Diego, CA (US)

(72) Inventors: Priti Pharkya, San Diego, CA (US); Anthony P. Burgard, Bellefonte, PA (US); Stephen J. Van Dien, Encinitas, CA (US); Robin E. Osterhout, San Diego, CA (US); Mark J. Burk, San Diego, CA (US); John D. Trawick, La Mesa, CA (US); Michael P. Kuchinskas, Escondido, CA (US); Brian Steer, San Diego, CA (US); Stefan Andrae, San Diego, CA (US); Amit Shah, San Diego, CA (US)

(73) Assignee: Genomatica, Inc., San Diego, CA (US)

( * ) Notice: Subject to any disclaimer, the term of this patent is extended or adjusted under 35 U.S.C. 154(b) by 419 days.

(21) Appl. No.: 15/191,421

(22) Filed: Jun. 23, 2016

(65) Prior Publication Data

US 2017/0183694 A1    Jun. 29, 2017

Related U.S. Application Data

(63) Continuation of application No. 14/262,461, filed on Apr. 25, 2014, now abandoned.

(60) Provisional application No. 61/854,611, filed on Apr. 26, 2013.

(51) Int. Cl.
| | | |
|---|---|---|
| *C12P 7/18* | (2006.01) |
| *C07C 31/20* | (2006.01) |
| *C07C 47/19* | (2006.01) |
| *C07C 211/09* | (2006.01) |
| *C07D 307/33* | (2006.01) |
| *C12N 1/20* | (2006.01) |
| *C12N 9/04* | (2006.01) |
| *C12N 9/10* | (2006.01) |
| *C12N 15/52* | (2006.01) |
| *C12P 7/24* | (2006.01) |
| *C12P 7/42* | (2006.01) |
| *C12P 7/62* | (2022.01) |
| *C12P 13/00* | (2006.01) |
| *C12P 17/04* | (2006.01) |
| *C12P 19/32* | (2006.01) |

(52) U.S. Cl.
CPC .............. *C12P 7/18* (2013.01); *C07C 31/207* (2013.01); *C07C 47/19* (2013.01); *C07C 211/09* (2013.01); *C07D 307/33* (2013.01); *C12N 1/20* (2013.01); *C12N 9/0006* (2013.01); *C12N 9/13* (2013.01); *C12N 15/52* (2013.01); *C12P 7/24* (2013.01); *C12P 7/42* (2013.01); *C12P 7/62* (2013.01); *C12P 13/001* (2013.01); *C12P 13/005* (2013.01); *C12P 17/04* (2013.01); *C12P 19/32* (2013.01); *C12Y 208/03* (2013.01)

(58) Field of Classification Search
CPC .......... C12N 9/0008; C12N 1/20; C12N 9/13; C12N 15/52; C12P 7/18; C12P 7/42; C12P 13/001; C12P 17/04; C07C 31/207; C07C 47/19; C07C 211/09; C07D 307/33; C12Y 208/03
See application file for complete search history.

(56) References Cited

U.S. PATENT DOCUMENTS

| | | | |
|---|---|---|---|
| 4,048,196 A | 9/1977 | Broecker et al. | |
| 4,301,077 A | 11/1981 | Pesa et al. | |
| 4,652,685 A | 3/1987 | Cawse et al. | |
| 5,019,509 A * | 5/1991 | Rozzell | C12N 9/88 435/116 |
| 5,478,952 A | 12/1995 | Schwartz | |
| 5,565,027 A * | 10/1996 | Shawl | C04B 24/2635 106/724 |
| 6,686,194 B1 | 2/2004 | Mutzel et al. | |
| 6,686,310 B1 | 2/2004 | Kourtakis et al. | |
| 7,127,379 B2 | 10/2006 | Palsson et al. | |
| 7,393,676 B2 | 7/2008 | Gokarn et al. | |

(Continued)

FOREIGN PATENT DOCUMENTS

| | | |
|---|---|---|
| CN | 102762735 A | 10/2012 |
| CN | 102965401 A | 3/2013 |

(Continued)

OTHER PUBLICATIONS

Kosaka et al. (2007) Characterization of the sol operon in butanol-hyperproducing Clostridium saccharoperbutylacetonicum strain N1-4 and its degeneration mechanism, Biosci. Biotechnol. Biochem., vol. 71, pp. 58-68.*

(Continued)

*Primary Examiner* — Paul J Holland
(74) *Attorney, Agent, or Firm* — Greenberg Traurig, LLP

(57) ABSTRACT

The invention provides non-naturally occurring microbial organisms having a 4-hydroxybutyrate, gamma-butyrolactone, 1,4-butanediol, 4-hydroxybutanal, 4-hydroxybutyryl-CoA and/or putrescine pathway and being capable of producing 4-hydroxybutyrate, wherein the microbial organism comprises one or more genetic modifications. The invention additionally provides methods of producing 4-hydroxybutyrate, gamma-butyrolactone, 1,4-butanediol, 4-hydroxybutanal, 4-hydroxybutyryl-CoA and/or putrescine or related products using the microbial organisms.

17 Claims, 90 Drawing Sheets

Specification includes a Sequence Listing.

(56) References Cited

U.S. PATENT DOCUMENTS

| | | | |
|---|---|---|---|
| 7,858,350 | B2 | 12/2010 | Burk et al. |
| 7,947,483 | B2 | 5/2011 | Burgard et al. |
| 8,067,214 | B2 | 11/2011 | Burk et al. |
| 8,129,156 | B2 | 3/2012 | Burk et al. |
| 8,129,169 | B2 | 3/2012 | Van Dien et al. |
| 8,178,327 | B2 | 5/2012 | Burk et al. |
| 8,357,520 | B2 | 1/2013 | Burk et al. |
| 8,377,666 | B2 | 2/2013 | Haselbeck et al. |
| 8,377,667 | B2 | 2/2013 | Haselbeck et al. |
| 8,470,582 | B2 | 6/2013 | Burgard et al. |
| 8,889,399 | B2 | 11/2014 | Burk et al. |
| 8,969,054 | B2 | 3/2015 | Burk et al. |
| 9,175,297 | B2 | 11/2015 | Burk et al. |
| 9,434,964 | B2 | 9/2016 | Van Dien et al. |
| 9,487,803 | B2 | 11/2016 | Burk et al. |
| 9,677,045 | B2 | 6/2017 | Pharkya et al. |
| 10,273,508 | B2 | 4/2019 | Van Dien et al. |
| 2002/0012939 | A1 | 1/2002 | Palsson |
| 2002/0168654 | A1 | 11/2002 | Maranas et al. |
| 2003/0059792 | A1 | 3/2003 | Palsson et al. |
| 2003/0203467 | A1* | 10/2003 | Gualfetti ............ C11D 3/38645 435/209 |
| 2003/0224363 | A1 | 12/2003 | Park et al. |
| 2003/0233218 | A1 | 12/2003 | Schilling |
| 2004/0005269 | A1* | 1/2004 | Huang ................ B01J 23/83 423/447.3 |
| 2004/0005296 | A1 | 1/2004 | Yonemitsu et al. |
| 2004/0009466 | A1 | 1/2004 | Maranas et al. |
| 2004/0029149 | A1 | 2/2004 | Palsson et al. |
| 2004/0072723 | A1 | 4/2004 | Palsson et al. |
| 2004/0210967 | A1* | 10/2004 | Chen ................ C07H 21/04 800/287 |
| 2004/0253591 | A1* | 12/2004 | Harrington ............ C12N 15/01 435/6.13 |
| 2005/0221466 | A1 | 10/2005 | Liao et al. |
| 2008/0015116 | A1* | 1/2008 | Bass ................ B01J 19/0046 506/35 |
| 2009/0047719 | A1 | 2/2009 | Burgard et al. |
| 2009/0075351 | A1 | 3/2009 | Burk et al. |
| 2010/0120105 | A1* | 5/2010 | Anthony ........ C12Y 101/01049 435/157 |
| 2011/0045575 | A1* | 2/2011 | Van Dien .............. C12P 7/18 435/252.33 |
| 2011/0171649 | A1* | 7/2011 | Kutyavin ............ C12Q 1/6818 435/6.11 |
| 2013/0029381 | A1 | 1/2013 | Haselbeck et al. |
| 2013/0251786 | A1 | 9/2013 | Li et al. |
| 2014/0045232 | A1 | 2/2014 | Park et al. |
| 2014/0371417 | A1* | 12/2014 | Pharkya ............ C07C 47/19 528/68 |

FOREIGN PATENT DOCUMENTS

| | | |
|---|---|---|
| GB | 1230276 | 4/1971 |
| GB | 1314126 | 4/1973 |
| GB | 1344557 | 1/1974 |
| GB | 1512751 | 6/1978 |
| WO | WO 1982/003854 | 11/1982 |
| WO | WO 2002/055995 | 7/2002 |
| WO | WO 2003/106998 | 12/2003 |
| WO | WO 2008/027742 | 3/2008 |
| WO | WO 2008/115840 | 9/2008 |
| WO | WO 2009/023493 | 2/2009 |
| WO | WO 2010/030711 | 3/2010 |
| WO | WO 2010/141920 | 12/2010 |
| WO | WO 2011/047101 | 4/2011 |
| WO | WO 2011/066076 | 6/2011 |
| WO | WO 2012/177943 | 12/2012 |
| WO | WO 2013/184602 | 12/2013 |
| WO | WO 2014/176514 | 10/2014 |

OTHER PUBLICATIONS

Reference (2019, updated) Clostridium saccharoperbutylacetonicum: Cspa_c56880, pp. 1-2.*

Hong R. (1999) "The Cloning of a Putative Regulatory Gene and the sol Regionfrom Clostridium beijerincki", Thesis for Master of science, Virginia Polytechnic Institute and State University, pp. 1-56.*

NCBI butyraldehyde dehydrogenase (2011) www.ncbi.nlm.nih.gov/protein/AAP42563.1, pp. 1-2.*

Singh RK et al. Protein Engineering Approaches in the Post-Genomic Era. Current Protein and Peptide Science, 2017, 18, 1-11. (Year: 2017).*

Zhang M et al. Propagated Perturbations from a Peripheral Mutation Show Interactions Supporting WW Domain Thermostability. 2018. Structure. 26, 1474-1485. (Year: 2018).*

Aberhart et al., "Stereospecific hydrogen loss in the conversion of [2H7]isobutyrate to beta-hydroxyisobutyrate in Pseudomonas putida. The stereochemistry of beta-hydroxyisobutyrate dehydrogenase," *J. Chem. Soc. Perkinl.*, 6:1404-1406 (1979).

Abiko et al., "Localization of NAD-isocitrate dehydrogenase and glutamate dehydrogenase in rice roots: candidates for providing carbon skeletons to NADH-glutamate synthase," *Plant Cell Physiol.*, 46(10):1724-1734 (2005).

Aevarsson et al., "Crystal structure of 2-oxoisovalerate and dehydrogenase and the architecture of 2-oxo acid dehydrogenase multienzyme complexes," *Nat. Struct. Biol.*, 6:785-792 (1999).

Alber et al., "Malonyl-coenzyme A reductase in the modified 3-hydroxypropionate cycle for autotrophic carbon fixation in archaeal Metallosphaera and *Sulfolobus* spp.," *J. Bacteriol.*, 188:8551-8559 (2006).

Alberty, "Biochemical thermodynamics," *Biochim. Biophys. Acta*, 1207:1-11 (1994).

Alhapel et al., "Molecular and functional analysis of nicotinate catabolismin Eubacterium barkeri," *Proc. Natl. Acad. Sci. U.S.A.*, 103(33)12341-12346 (2006).

Altschul et al., "Basic Local Alignment Search Tool," *J. Mol. Biol.*, 215:403-410 (1990).

Andersen et al., "A gene duplication led to specialized gamma-aminobutyrate and beta-alaine aminotransferase in yeast," *FEBS J.*, 274(7):1804-1817 (2007).

Andersen et al., "Cloning of the lysA gene from Mycobacterium tuberculosis," *Gene*, 124:105-109 (1993).

Angov et al., "Codon usage: Nature's roadmap to expression and folding of proteins," *Biotechnol. J.*, 6(6):650-659 (2011).

Ansorge et al., "Production of Recombinant L-Leucine Dehydrogenase from Bacillus cereus in Pilot Scale Using the Runaway Replication System *E. coli*[pIET98]," *Biotechnol. Bioeng.*, 68(5):557-562 (2000).

Araujo et al., "Before It Gets Started: Regulating Translation at the 5' UTR," *Comp. Funct. Genomics*, 475731 (2012).

Arraiano et al., "The critical role of RNA processing and degradation in the control of gene expression," *FEMS Microbiol. Rev.*, 34(5):883-923 (2010).

Asano et al., "Crystalline 3-methylaspartase from a facultative anaerobe, *Escherichia coli* strain YG1002," *FEMS Microbiol. Lett.*, 118(3):255-258 (1994).

Asano et al., " Alteration of substrate specificity of aspartase by directed evolution," *Biomol. Eng.*, 22:95-101 (2005).

Asuncion et al., "Overexpression, purification, crystallization and data collection of 3-methylaspartase from Clostridium tetanomorphum," *Acta Crystallogr. D. Biol. Crystallogr.*, 57:731-733 (2001).

Asuncion et al., "The Structure of 3-Methylaspartase from Clostridium tetanomorphum Functions via the Common Enolase Chemical Step," *J. Biol. Chem.*, 277(10):8306-8311 (2002).

Atlung et al., "Effects of sigmaS and the transcriptional activator AppY on induction of the *Escherichia coli* hya and cbdAB-appA operons in response to carbon and phosphate starvation," *J. Bacteriol.*, 179:2141-2146 (1997).

Atsumi et al., "Metabolic engineering of *Escherichia coli* for 1-butanol production," *Metab. Eng.*, 10:305-311 (2008).

Atsumi et al., "Non-fermentative pathways for synthesis of branched-chain higher alcohols as biofuels," *Nature*, 451(7174):86-89 (2008).

(56) References Cited

OTHER PUBLICATIONS

Baker et al., "Purification and properties of L-erythro-3,5-diaminohexanoate dehydrogenase from a lysine-fermenting Clostirdium," *J. Biol. Chem.*, 247(23):7724-7734 (1972).

Baker et al., "Purification and properties of L-erythro-3,5-diaminohexanoate dehydrogenase from Clostridium sticklandii," *Biochemistry*, 13(2):292-299 (1974).

Barker et al., "Pathway of Lysine Degradation in Fusobacterium nucleatum," *J. Bacteriol.*, 152(1):201-207 (1982).

Barrowman et al., "Immunological comparison of microbial TPP-dependent non-oxidative alpha-keto acid decarboxylase," *FEMS Microbiology Lett.*, 34:57-60 (1986).

Barthelmebs et al., "Expression of Escherichia coli of Native and Chimeric Phenolic Acid Decarboxylases with Modified Enzymatic activites and Method for Screening recombinant *E. coli* Strains Expressing These Enzymes," *Appl. Environ. Microbiol.*, 67:1063-1069 (2001).

Bartsch et al., "Molecular analysis of two genes of the *Escherichia coli* gab cluster: nucleotide sequence of the glutamate:succinic semialdehyde transaminase gene (gabT) and characterization of the succinic semialdehyde dehydrogenase gene (gabD)," *J. Bacteriol.*, 172:7035-7042 (1990).

Bekker et al., "Respiration of *Escherichia coli* Can Be Fully Uncoupled via the Nonelectrogenic Terminal Cytochrome bd-II Oxidase," *J. Bacteriol.*, 191(17):5510-5517 (2009).

Berg et al., "A 3-Hydroxypropionate/4-Hydroxybutyrate Autotrophic Carbon Dioxide Assimilation Pathway in Archaea," *Science*, 318:1782-1786 (2007).

Bergquist et al., "Degenerate oligonucleotide gene shuffling (DOGS) and random drift mutagenesis (RNDN): two complementary techniques for enzyme evolution," *Biomol. Eng.*, 22:63-72 (2005).

Bergquist et al., "Degenerate oligonucleotide gene shuffling," *Methods Mol. Biol.*, 352:191-204 (2007).

Berkovitch et al., "A locking mechanism preventing radical damage in the absence of substrate, as revealed by the x-ray structure of lysine 5,6-aminomutase," *Proc. Natl. Acad. Sci. U.S.A.*, 101:15870-15875 (2004).

Biellmann et al., "Aspartate-beta-semialdehyde dehydrogenase from *Escherichia coli*. Purification and general properties," *Eur. J. Biochem.*, 104(1):53-58 (1980).

Bisswanger, "Substrate Specificity of the Pyruvate Dehydrogenase Complex from *Escherichi coli*," *J. Biol. Chem.*, 256(2):815-822 (1981).

Blanco et al., "Critical catalytic functional groups in the mechanims of aspartate-β-semialdehyde dehydrogenase," *Acta Crystallogr. D. Biol. Crystallogr.*, 60:1808-1815 (2004).

Blanco et al., "The role of substrate-binding roups in the mechanism of asparte-β-semialdehyde dehydrogenase," *Acta Crystallogr. D. Biol. Crystallog.*, 60:1388-1395 (2004).

Bleykasten-Grosshans et al., "Transposable elements in yeasts," *C.R. Biol.*, 33(8-9):679-686 (2011).

Bonnarme et al., "Itaconate biosynthesis in Aspergillus terreus," *J. Bacteriol.*, 177(12):3573-3578 (1995).

Bonner et al., "Purification and Properties of Fatty Acyl Thiesterase I from *Escherichia coli*," *J. Biol. Chem.*, 247(10) 3123-3133 (1972).

Borisov et al., " Aerobic respiratory chain of *Escherichia coli* is not allowed to work in fully uncoupled mode," *Proc. Natl. Acad. Sci. USA*, 108:17320-17324 (2011).

Botting et al., "Substrate Specificity of the 3-Methylaspartate Ammonia-Lyase Reaction: Observation of Differential Relative Reaction rates for Substrate-Product Pairs," *Biochemistry*, 27:2953-2955 (1988).

Bower et al., "Cloning, Sequencing, and Characterization of the Bacillus subtilis Biotin Biosynthetic Operon," *J. Bacteriol.*, 178(14):4122-4130 (1996).

Boynton et al., "Cloning, sequencing, and expression of clustered genes encoding beta-hydroxybutyryl-coenzyme A (CoA) dehydrogenase, crotonase, and butyryl-CoA dehydrogenase from Clostridium acetobutylicum ATCC 824," *J. Bateriol.*, 178(11):3015-3024 (1996).

Bradford et al., " A rapid and sensitive method for the quantitation of microgram quantities of protein utilizing the principle of protein-dye binding," *Anal. Biochem.*, 72:248-254 (1976).

Branlant et al., "Nucleotide sequence of the *Escherichia coli* gap gene. Differente evolutionay behaviour of the Nad+-binding domain and of the catalytic domain of D-glyceraldehyde-3-phosphate dehydrogenase," *Eur. J. Biochem.*, 150(1):61-66 (1985).

Brasen et al., "Unusual ADP-forming acetyl-coenzyme A synthetases from the mesophilic halophilic eurarchaeon Haloarcula marismortui and from the hyperthermophilic crenarchaeon Pyrobaculum aerophilum," *Arch. Microbiol.*, 182:277-287 (2004).

Bravo et al., "Reliable, sensitive, rapid and quantitative enzyme-based assay for gamma-hydroxybutyric acid (GHB)," *J. Forensic Sci.*, 49:379-387 (2004).

Breitkreuz et al., "A novel gamma-hydroxybutyrate dehydrogenase: identification and expression of an *Arabidopsis* cDNA and potential role under oxygen deficiency," *J. Biol. Chem.*, 278:41552-41556 (2003).

Bremer, "Pyruvate Dehydrogenase, Substrate Specificity and Product Inhibition," *Eur. J. Biochem.*, 8:535-540 (1969).

Brosch et al., "Genome plasticity of BCG and impact on vaccine efficacy," *Proc. Natl. Acad. Sci. U.S.A.*, 104(13):5596-5601 (2007).

Bu et al., "Two human glutamate decarboxylases, 65-kDa GAD and 67-kDa GAD, are each encoded by a single gene," *Proc. Natl. Acad. Sci. U.S.A.*, 89(6):2115-2119 (1992).

Bu et al., "The exon-intron organization of the genes (GAD1 and GAD2) encoding two human glutamate decarboxylases (GAD67 and GAD65) suggests that they derive from a common ancestral GAD," *Genomics*, 21:222-228 (1994).

Buck et al., "Primary Structure of the Succinyl-CoA Synthetase of *Escherichia coli*," *Biochemistry*, 24:6245-6252 (1985).

Buckel et al., "Glutaconate CoA-Transferase from Acidaminococcus fermentans," *Eur. J. Biochem.*, 118:315-321 (1981).

Burgard et al., "Minimal Reaction Sets for *Escherichia coli* Metabolism under Different Growth Requirements and Uptake Environments," *Biotechnol. Prog.*, 17:791-797 (2001).

Burgard et al., "Optknock: a bilevel programming framework for identifying gene knockout strategies for microbial strain optimization," *Biotechnol. Bioeng.*, 84(6):647-657 (2003).

Buu et al., "Functional Characterization and Localization of Acetyl-CoA Hydrolase, Ach1p, in *Saccharomyces cerevisiae*," *J. Biol. Chem.*, 278(19):17203-17209 (2003).

Calhoun et al., " Energetic efficiency of *Escherichia coli*: effects of mutations in components of the aerobic respiratory chain," *J. Bacteriol.*, 175:3020-3025 (1993).

Campbell et al., "A new Escherichia coli metabolic competency: growth on fatty acids by a novel anaerobic β-oxidation pathway," *Mol. Microbiol.*, 47(3):793-805 (2003).

Carlier et al., " The assimilation of gamma-butyrolactone in Agrobacterium tumefaciens C58 interferes with the accumulation of the N-acyl-homoserine lactone signal," *Mol. Plant Microbe Interact.*, 17(9):951-957 (2004).

Cary et al., "Cloning and expression of Clostridium acetobutylicum ATCC 824 acetoacetyl-coenzyme A:acetate/butyrate:coenzyme A-transferase in *Escherichia coli*," *Appl. Environ. Microbiol.*, 56(6):1576-1583 (1990).

Cary et al., "Cloning and expression of Clostridium acetobutylicum phosphotransbutyrylase and butyrate kinase genes in *Escherichia coli*," *J. Bacteriol.*, 170(10):4613-4618 (1988).

Caspi et al., "MetaCyc: a multiorganism database of metabolic pathways and enzymes," *Nucleic Acids Res.*, 34(Database issue):D511-D516 (2006).

Castel et al., "RNA interference (RNAi) in the Nucleus: roles for small RNA in transcription, epigenetics and beyond," *Nat. Rev. Genet.*, 14(2):100-112 (2013).

Cha et al. "Succinic Thiokinase. I. Purification of the Enzyme from Pig Heart," *J. Biol. Chem.*, 239:1961-1967 (1964).

Chandra et al., "Pyruvate decarboxylase: a key enzyme for the oxidative metabolism of lactic acid by Acetobacter pasteruianus," *Arch. Microbiol.*, 176:443-451 (2001).

Chao et al., "The Effects of Wall Population on Coexistence of Bacteria in the Liquid Phase of Chemostat Cultures," *J. Gen. Microbiol.*, 20:1229-1236 (1985).

(56) References Cited

OTHER PUBLICATIONS

Chen et al., "A novel lysine 2,3-aminomutase encoded by the yodO gene of Bacillus subtilis: characterization and the observation of organic radical intermediates," *Biochem. J.*, 348:539-549 (2000).

Chen et al., "Cloning, Sequencing, Heterologous Expression, Purification, and Characterization of Adenosylcobalamin-dependent D-Ornithine Aminomutase from Clostridium sticklandii," *J. Biol. Chem.*, 276:44744-44750 (2001).

Chicco et al., "Regulation of Gene Expression of Branched-chain Keto Acid Dehydrogenase Complex in Primary Cultured Hepatocytes by Dexamethasone and cAMP Analog," *J. Biol. Chem.*, 269(30):19427-19434 (1994).

Chirpich et al., "Lysine 2,3-Aminomutase. Purification and properties of a pyridoxal phosphate and S-adenosylmethionine-activated enzyme," *J. Biol. Chem.*, 245(7):1778-1789 (1970).

Cho et al., "Critical residues for the coenzyme specificity of NAD+-deptendent 15-hydroxyprtaglandin dehydrogenase," *Arch. Biochem. Biophys.*, 419(2): 139-146 (2003).

Chowdhury et al., "Cloning and Overexpression of the 3-Hydroxyisobutyrate Dehydrogenase Gene from Pseudomonas putida E23," *Biosci. Biotechnol. Biochem.*, 67(2):438-441 (2003).

Chowdhury et al., "3-Hydroxyisobutyrate dehydrogenase from Pseudomonas putida E23: purification and characterization," *Biosci. Biotechnol. Biochem.*, 60(12):2043-2047 (1996).

Christenson et al., "Kinetic analysis of the 4-methylideneimidazole-5-one-containing tyrosine aminomutase in enediyne antitumor antibiotic C-1027 biosynthesis," *Biochemistry*, 42(43):12708-12718 (2003).

Clarke et al., "Rational construction of a 2-hydroxyacid dehydrogenase with new substrate specificity," *Biochem. Biophys. Res. Commun.*, 148:15-23 (1987).

Clausen et al., "PADI encodes phenylacrylic acid decarboxylase which confers resistance to cinnamic acid in *Saccharomyces cerevisiae*," *Gene*, 142:107-112 (1994).

Coco et al., "DNA shuffling method for generating highly recombined genes and evolved enzymes," *Nat. Biotechnol.*, 19(4):354-359 (2001).

Colby et al., "Purification and properties of 3-Hydroxybutyryl-Coenzyme A Dehydrogenase from Clostridium beijerinckii (Clostridium butylicum:) NRRL B593," *Appl. Environ. Microbiol.*, 58:3297-3302 (1992).

Coleman et al., "Expression of a glutamate decarboxylase homologue is required for normal oxidative stress tolerance in *Saccharomyces cerevisiae*," *J. Biol. Chem.*, 276:244-250 (2001).

Colonna et al., "Synthesis and radiocarbon evidence of terephthalate polyesters completely prepared from renewable resources," *Green Chemistry*, 13:2543-2548 (2011).

Cooper, "Glutamate-y-aminobutyrate transaminase," *Methods Enzymol.*, 113:80-82 (1985).

Currie et al., "Authentication and dating of biomass components of industrial materials; links to sustainable technology," *Nucl. Instrum. Methods Phys. Res. B*, 172:281-287 (2000).

Daigaku et al., "Loss of heterozygosity in yeast can occur by ultraviolet irradiation during the S phase of the cell cycle," *Mutation Res.*, 600(1-2):177-183 (2006).

Datsenko et al., "One-step inactivation of chromosomal genes in Escherichia coli K-12 using PCR products," *Proc. Natl. Acad. Sci. U.S.A.*, 97(12):6640-6645 (2000).

Davie et al., "Expression and Assembly of a Functional E1 Component ($\alpha 2\beta 2$) of Mammalian Branched-Chain $\alpha$-Ketoacid Dehydrogenase Complex in *Escherichia coli*," *J. Biol. Chem.*, 267:16601-16606 (1992).

De Biase et al., "Isolation, overexpression, and biochemical characterization of the two isoforms of glutamic acid decarboxylase from *Escherichia coli*," *Protein Expr. Purif.*, 8:430-438 (1996).

De Crecy et al., "Development of a novel continuous culture device for experimental evolution of bacterial populations," *Appl. Microbiol. Biotechnol.*, 77:489-496 (2007).

De La Torre et al., "Identification and functional analysis of prokaryotic-type aspartate aminotransferase: implications for plant amino acid metabolism," *Plant J.*, 46(3):414-425 (2006).

Deana, "Substrate specificity of a dicarboxyl-CoA: dicarboxylic acid coenzyme A transferase from rat liver mitochondria," *Biochem. Int.*, 26(4):767-773 (1992).

Diao et al., "Crystal Structure of Butyrate Kinase 2 from Thermotoga maritima, a Member of the ASKHA Superfamily of Phosphotransferases," *J. Bacteriol.*, 191(8):2521-2529 (2009).

Diao et al., "Crystallization of butyrate kinase 2 from Thermotoga maritima medicated by varpor diffusion of acetic acid," *Acta Crystallogr. D. Crystallogr.*, 59:1100-1102 (2003).

Diaz et al., "Gene cloning, heterologous overexpression and optimized refolding of the NAD-glutamate dehydrogenase from haloferax mediterranei," *Extremophiles*, 10(2):105-115 (2006).

Diderichsen et al., "Cloning of aldB, which encodes alpha-acetolactate decarboxylase, an exoenzyme from Bacillus brevis," *J. Bacteriol.*, 172(8):4315-4321 (1990).

Dietrich et al., "High-Throughput Metabolic Engineering: Advances in Small-Molecule Screening and Selection," *Annu. Rev. Biochem.*, 79:563-590 (2010).

Donnelly et al., "Succinic semialdehyde dehydrogenases of *Escherichia coli*: Their role in the degradation of p-hydroxyphenylacetate and $\gamma$-aminobutyrate," *Eur. J. Biochem.*, 113:555-561 (1981).

Donnelly et al., "Two succinic semialdehyde dehydrogenases are induced when *Escherichia coli* K-12 is grown on gamma-aminobutyrate," *J. Bacteriol.*, 145:1425-1427 (1981).

Donovan et al., "Review: Optimizing inducer and culture conditions for expression of foreign protecins under the control of the lac promoter," *J. Ind. Microbiol.*, 16(3):145-154 (1996).

Doyle et al., "Structural basis for a change in substrate specificity: crystal structure of S113E isocitrate dehydrogenase in a complex with isopropylmalate, Mg2+, and NADP," *Biochemistry*, 40(14):4234-4241 (2001).

Drake, "Acetogenesis, acetogenic bacteria, and the acetyl-CoA "Wood/Ljungdahl" pathway: past and current perspectives," In H.L. Drake (ed.), *Acetogenesis*, pp. 3-60 Chapman and Hall, New York (1994).

Drewke et al., "4-O-Phosphoryl-L-threonine, a substrate of the pdxC(serC) gene product involved in vitamin B6 biosynthesis," *FEBS Lett.*, 390:179-182 (1996).

Duncan et al., "Acetate utilization and butyryl coenzyme A (CoA): acetate-CoA transferase in butyrate-producing bacteria from the human large intestine," *Appl. Environ. Microbiol.*, 68(10):5186-5190 (2002).

Dürre et al., "Solventogenic enzymes of Clostridium acetobutylicum: catalytic properties, genetic organization, and transcriptional regulation," *EFEMS Microbiol. Rev.*, 17(3):251-262 (1995).

Dykhuizen, " Chemostats used for studying natural selection and adaptive evolution," *Methods Enzymol.*, 613-631 (1993).

Efe et al., "Options for biochemical production of 4-hydroxybutyrate and its lactone as a substitute for petrochemical production," *Biotechnol. Bioeng.*, 99:1392-1406 (2008).

Estevez et al., "X-ray crystallographic and kinetic correlation of a clinically observed human fumarase mutation," *Protein Sci.*, 11:1552-1557 (2002).

Faehnle et al., "A New Branch in the Family: Structure of Aspartate-$\beta$-semialdehyde dehydrogenase from Methanococcus jannaschii," *J. Mol. Biol.*, 353:1055-1068 (2005).

Fernandez-Valverde et al., "Purification of Pseudomonas putida Acyl coenzyme a Ligase Active with a Range of Aliphatic and Aromatic Substrates," *Appl. Environ. Microbiol.*, 59:1149-1154 (1993).

Fischer et al., "Metabolic flux profiling of *Escherichi coli* mutants in central carbon metabolism using GC-MS," *Eur. J. Biochem.*, 270(5) 880-891 (2003).

Fong et al., "Description and interpretation of adaptive evolution of *Escherichia coli* K-12 MG1655 by using a genome-scale in silico metabolic model," *J. Bacteriol.*, 185(21):6400-6408 (2003).

Fong et al., "In silico design and adaptive evolution of *Escherichia coli* for production of lactic acid," *Biotechnol. Bioeng.*, 91:643-648 (2005).

(56) References Cited

OTHER PUBLICATIONS

Fong et al., "Metabolic gene-deletion strains of *Escherichia coli* evolve to computationally predicted growth phenotypes," *Nat. Genet.*, 36(10):1056-1058 (2004).
Fontaine et al., "Molecular characterization and transcriptional analysis of adhE2, the gene encoding the NADH-dependent aldehyde/alcohol dehydrogenase responsible for butanol production in alcohologenic cultures of Clostridium acetobutylicum ATCC 824," *J. Bacteriol.*, 184(3):821-830 (2002).
Ford et al., "Molecular properties of the lys1+ gene and the regulation of alpha-aminoadipate reductase in Schizosaccharomyces pombe," *Curr. Genet.*, 28(2):131-137 (1995).
Fries et al., "Reaction Mechanism of the Heteroameric (α2β2) E1 Component of 2-Oxo Acid Dehydrogenase Multienzyme Complexes," *Biochemistry*, 42:6996-7002 (2003).
Fujii et al., "Characterization of L-lysine 6-aminotransferase and its structural gene from Favobacterium lutescens IFO3084," *J. Biochem.*, 128(3):391-397 (2000).
Fujii et al., "Error-prone rolling circle amplification: the simplest random mutagenesis protocol," *Nat. Protoc.*, 1(5):2493-2497 (2006).
Fujii et al., "One-step random mutagenesis by error-prone rolling circle amplification," *Nucleic Acids Res.*, 32(19):e145 (2004).
Fujita et al., "Novel Substrate Specificity of designer3-Isopropylmalate Dehydrogenase Derived from thermus thermophilus HB1," *Biosci. Biotechnol. Biochem.*, 65(12):2695-2700 (2001).
Fukuda et al., "Role of a highly conserved YPITP motif in 2-oxoacid:ferredoxin oxidoreductase," *Eur. J. Biochem.*, 268:5639-5646 (2001).
Fukuda et al., "Substrate recognition by 2-oxoacid:ferredoxin oxidoreductase from *Sulfolobus* sp. Strain 7," Biochim. Biophys. Acta, 1597:74-80 (2002).
Gay et al., "Cloning Structural Gene sacB, Which codes for Exoenzyme Levansucrase of Bacillus subtilis: Epxresion of the Gene in *Escherichia coli,*" *J. Bacteriol.*, 153:1424-1431 (1983).
GenBank Accession No. 3EH7_A, "Chain A, 4-hydroxybutyrate Coa-transferase," Jan. 10, 2013.
GenBank Accession No. 3GK7_A, "Chain A, Crystal Structure Of 4-Hydroxybutyrate Coa-Transferase From Clostridium Aminobutyricum, " Oct. 10, 2012.
GenBank Accession No. AAA92344.1, "4-hydroxybutyrate coenzyme A transferase [Clostridium kluyveri DSM 555]," Mar. 15, 1996.
GenBank Accession No. AAD31841.1, "coenzyme A acylating aldehyde dehydrogenase [Clostridium beijerinckii]," May 17, 2004.
GenBank Accession No. AAM18705.1, "alcohol dehydrogenase [Clostridium beijerinckii]," May 5, 2004.
GenBank Accession No. AAM18709.1, "alcohol dehydrogenase [Clostridium beijerinckii]," Apr. 24, 2002.
GenBank Accession No. AAP42563.1, "butyraldehyde dehydrogenase [Clostridium saccharoperbutylacetonicum N1-4(HMT)]," Oct. 17, 2011.
GenBank Accession No. ABA39275.1, "4-hydroxybutyrate CoA-transferase [Anaerostipes caccae]," Jan. 5, 2007.
GenBank Accession No. ABC25528.1, "aldehyde dehydrogenase [Roseburia inulinivorans DSM 16841]," Jun. 5, 2006.
GenBank Accession No. AGE10401.1, "butanol dehydrogenase [Clostridium sp. G117]," Feb. 5, 2013.
GenBank Accession No. CAB60036.2, "4-Hydroxybutyrate CoA-transferase [Clostridium aminobutyricum]," May 13, 2008.
GenBank Accession No. CAQ53139.1, "NADPH-depended butanol dehydrogenase [Clostridium saccharobutylicum]," May 13, 2008.
GenBank Accession No. CAQ57983.1, "coenzyme A acylating aldehyde dehydrogenase [Clostridium saccharobutylicum]," Sep. 17, 2009.
GenBank Accession No. EMP15468.1, "4-hydroxybutyrate CoA-transferase [Fusobacterium nucleatum CC53]," Mar. 18, 2013.
GenBank Accession No. EMP16460.1, "4-hydroxybutyrate CoA-transferase [Fusobacterium nucleatum CC53]," Mar. 18, 2013.
GenBank Accession No. EMU52053.1, "NADH-dependent butanol dehydrogenase [Clostridium butyricum DKU-01]," Apr. 5, 2013.
GenBank Accession No. EMU52057.1, "NADH-dependent butanol dehydrogenase [Clostridium butyricum DKU-01]," Apr. 5, 2013.
GenBank Accession No. EMZ20682.1, "propionaldehyde dehydrogenase [*Clostridium* sp. ASF502]," Apr. 8, 2013.
GenBank Accession No. EMZ26775.1, "hypothetical protein C824_02214 [*Clostridium* sp. ASF502]," Apr. 8, 2013.
GenBank Accession No. EMZ27833.1, "propionaldehyde dehydrogenase [Eubacterium plexicaudatum ASF492]," Apr. 8, 2013.
GenBank Accession No. ENY83847.1, "propionaldehyde dehydrogenase [[Clostridium] clostridioforme CM201]," Apr. 19, 2013.
GenBank Accession No. ENY95324.1, "iron-containing alcohol dehydrogenase [[Clostridium] hathewayi 12489931]," Apr. 19, 2013.
GenBank Accession No. ENZ02568.1, "NADPH-dependent butanol dehydrogenase [Clostridium colicanis 209318]," Apr. 19, 2013.
GenBank Accession No. ENZ14597.1, "iron-containing alcohol dehydrogenase [[Clostridium] clostridioforme 90A7]," Apr. 19, 2013.
GenBank Accession No. ENZ17687.1, "hypothetical protein HMPREF1090_01637 [[Clostridium] clostridioforme 90A8]," Apr. 19, 2013.
GenBank Accession No. ENZ30148.1, "NADPH-dependent butanol dehydrogenase [Clostridium butyricum 60E.3]," Apr. 19, 2013.
GenBank Accession No. ENZ30152.1, "NADPH-dependent butanol dehydrogenase [Clostridium butyricum 60E.3]," Apr. 19, 2013.
GenBank Accession No. ENZ31577.1, "propionaldehyde dehydrogenase [[Clostridium] bolteae 90B8]," Apr. 19, 2013.
GenBank Accession No. NP_562172.1, "NADPH-dependent butanol dehydrogenase [Clostridium perfringens str. 13]," Dec. 21, 2012.
GenBank Accession No. NP_603518.1, "4-hydroxybutyrate coenzyme A transferase [*Fusobacterium nucleatum* subsp. nucleatum ATCC 25586]," Dec. 21, 2012.
GenBank Accession No. NP_781174.1, "4-hydroxybutyrate CoA-transferase [Clostridium tetani E88]," Feb. 25, 2013.
GenBank Accession No. NP_782951.1, "NADPH-dependent butanol dehydrogenase [Clostridium tetani E88]," Feb. 25, 2013.
GenBank Accession No. NP_904965.1, "4-hydroxybutyrate CoA-transferase [Porphyromonas gingivalis W83]," Dec. 21, 2012.
GenBank Accession No. P13604.1, "RecName: Full=NADPH-dependent butanol dehydrogenase; Short=BDH," Apr. 3, 2013.
GenBank Accession No. YP_001088854.1, "4-hydroxybutyrate CoA-transferase [Clostridium difficile 630]," Aug. 31, 2012.
GenBank Accession No. YP_001254145.1, "NADH-dependent butanol dehydrogenase [Clostridium botulinum A str. ATCC 3502]," Sep. 27, 2012.
GenBank Accession No. YP_001275270.1, "acetyl-CoA hydrolase/transferase [*Roseiflexus* sp. RS-1]," Jan. 25, 2012.
GenBank Accession No. YP_001308850.1, "iron-containing alcohol dehydrogenase [Clostridium beijerinckii NCIMB 8052]," Sept. 4, 2012.
GenBank Accession No. YP_001309226.1, acetyl-CoA hydrolase/transferase [Clostridium beijerinckii NCIMB 8052], Sept. 4, 2012.
GenBank Accession No. YP_001309304.1, "iron-containing alcohol dehydrogenase [Clostridium beijerinckii NCIMB 8052]," Sept. 4, 2012.
GenBank Accession No. YP_001310903.1, "aldehyde dehydrogenase [Clostridium beijerinckii NCIMB 8052]," Sept. 4, 2012.
GenBank Accession No. YP_001311111.1, "aldehyde dehydrogenase [Clostridium beijerinckii NCIMB 8052]," Sept. 4, 2012.
GenBank Accession No. YP_001390980.1, "NADH-dependent butanol dehydrogenase [Clostridium botulinum F str. Langeland]," Dec. 22, 2012.
GenBank Accession No. YP_001393945.1, "Adh1 [Clostridium kluyveri DSM 555]," Dec. 22, 2012.
GenBank Accession No. YP_001396397.1, "hypothetical protein CKL_3018 [Clostridium kluyveri DSM 555]," Dec. 22, 2012.
GenBank Accession No. YP_001396957.1, "hypothetical protein CKL_3595 [Clostridium kluyveri DSM 555]," Dec. 22, 2012.
GenBank Accession No. YP_001433830.1, "acetyl-CoA hydrolase/transferase [Roseiflexus castenholzii DSM 13941]," Jan. 25, 2012.
GenBank Accession No. YP_001558295.1, "aldehyde dehydrogenase [Clostridium phytofermentans ISDg]," Feb. 14, 2012.

(56) References Cited

OTHER PUBLICATIONS

GenBank Accession No. YP_001663556.1, "hypothetical protein [Eubacterium limosum KIST612]," Dec. 24, 2012.
GenBank Accession No. YP_001781276.1, "NADH-dependent butanol dehydrogenase [Clostridium botulinum B1 str. Okra]," Dec. 23, 2012.
GenBank Accession No. YP_001787047.1, "NADH-dependent butanol dehydrogenase [Clostridium botulinum A3 str. Loch Maree]," Dec. 23, 2012.
GenBank Accession No. YP_001885942.1, "ethanolamine utilization protein EutE [Clostridium botulinum B str. Eklund 17B]," Dec. 23, 2012.
GenBank Accession No. YP_001886323.1, "ethanolamine utilization protein EutE [Clostridium botulinum B str. Eklund 17B]," Dec. 23, 2012.
GenBank Accession No. YP 001887401.1, "NADPH-dependent butanol dehydrogenase [Clostridium botulinum B str. Eklund 17B]," Dec. 23, 2012.
GenBank Accession No. YP_001921227.1, "ethanolamine utilization protein EutE [Clostridium botulinum E3 str. Alaska E43]," Dec. 23, 2012.
GenBank Accession No. YP_001922335.1, "NADPH-dependent butanol dehydrogenase [Clostridium botulinum E3 str. Alaska E43]," Dec. 23, 2012.
GenBank Accession No. YP_001928841.1, "4-hydroxybutyrate CoA-transferase [Porphyromonas gingivalis ATCC 33277]," Dec. 22, 2012.
GenBank Accession No. YP_002138233.1, "butyryl:4-hydroxybutyrate CoA transferase [Geobacter bemidjiensis Bem]," Aug. 22, 2011.
GenBank Accession No. YP_002430388.1, "acetyl-CoA hydrolase/transferase [Desulfatibacillum alkenivorans AK-01]," Dec. 22, 2012.
GenBank Accession No. YP_002470945.1, "hypothetical protein CKR_0480 [Clostridium kluyveri NBRC 12016]," Dec. 23, 2012.
GenBank Accession No. YP_003022652.1, "acetyl-CoA hydrolase/transferase [*Geobacter* sp. M21]," Dec. 22, 2012.
GenBank Accession No. YP_003639404.1, "Aldehyde Dehydrogenase [Thermincola potens JR]," Jan. 25, 2012.
GenBank Accession No. YP_003702013.1, "acetyl-CoA hydrolase/transferase [Syntrophothermus lipocalidus DSM 12680]," Dec. 31, 2012.
GenBank Accession No. YP_003780011.1, "iron-containing alcohol dehydrogenase [Clostridium ljungdahlii DSM 13528]," Dec. 24, 2012.
GenBank Accession No. YP_003780648.1, "NADPH-dependent butanol dehydrogenase [Clostridium ljungdahlii DSM 13528]," Dec. 24, 2012.
GenBank Accession No. YP_003782121.1, "NADPH-dependent butanol dehydrogenase [Clostridium ljungdahlii DSM 13528]," Dec. 24, 2012.
GenBank Accession No. YP_003821060.1, "iron-containing alcohol dehydrogenase [Clostridium saccharolyticum WM1]," Dec. 23, 2012.
GenBank Accession No. YP_003822025.1, "aldehyde dehydrogenase [Clostridium saccharolyticum WM1]," Dec. 23, 2012.
GenBank Accession No. YP_003824956.1, "Aldehyde Dehydrogenase [Thermosediminibacter oceani DSM 16646]," Dec. 23, 2012.
GenBank Accession No. YP_003830744.1, "iron-containing alcohol dehydrogenase [Butyrivibrio proteoclasticus B316]," Dec. 23, 2012.
GenBank Accession No. YP_003845251.1, "iron-containing alcohol dehydrogenase [Clostridium cellulovorans 743B]," Dec. 23, 2012.
GenBank Accession No. YP_003935705.1, "putative aldehyde dehydrogenase, ethanolamine utilization protein [[Clostridium] sticklandii]," Feb. 26, 2013.
GenBank Accession No. YP_003961977.1, "hypothetical protein [Eubacterium limosum KIST612]," Dec. 24, 2012.
GenBank Accession No. YP_003968466.1, "Aldehyde Dehydrogenase (plasmid) [Ilyobacter polytropus DSM 2926]," Jan. 25, 2012.
GenBank Accession No. YP_003989248.1, "aldehyde dehydrogenase [*Geobacillus* sp. Y4.1MC1]," Dec. 23, 2012.
GenBank Accession No. YP_004253244.1, "acetyl-CoA hydrolase/transferase [Odoribacter splanchnicus DSM 220712]," Dec. 24, 2012.
GenBank Accession No. YP_004309584.1, "alcohol dehydrogenase [Clostridium lentocellum DSM 5427]," Dec. 23, 2012.
GenBank Accession No. YP_004396877.1, "iron-containing alcohol dehydrogenase [Clostridium botulinum BKT015925]," Dec. 24, 2012.
GenBank Accession No. YP_004441567.1, "acetyl-CoA hydrolase/transferase [Porphyromonas asaccharolytica DSM 20707]," Oct. 20, 2011.
GenBank Accession No. YP_004471777.1, "acetaldehyde dehydrogenase [Thermoanaerobacterium xylanolyticum LX-11]," Dec. 31, 2012.
GenBank Accession No. YP_004510530.1, "4-hydroxybutyrate CoA-transferase [Porphyromonas gingivalis TDC60]," Dec. 25, 2012.
GenBank Accession No. YP_004587980.1, "acetaldehyde dehydrogenase [Geobacillus thermoglucosidasius C56-YS93]," Dec. 23, 2012.
GenBank Accession No. YP_004765391.1, "acetyl-CoA hydrolase/transferase [Megasphaera elsdenii DSM 20460]," Dec. 25, 2012.
GenBank Accession No. YP_005014371.1, "4-hydroxybutyrate CoA-transferase [Tannerella forsythia ATCC 43037]," Sep. 27, 2012.
GenBank Accession No. YP_005023154.1, "aldehyde dehydrogenase EutE [*Vibrio* sp. EJY3]," Dec. 25, 2012.
GenBank Accession No. YP_005055048.1, "4-hydroxybutyrate CoA-transferase [Filifactor alocis ATCC 35896]," Dec. 23, 2012.
GenBank Accession No. YP_005270223.1, "CoA-dependent proprionaldehyde dehydrogenase PduP [Acetobacterium woodii DSM 1030]," Dec. 24, 2012.
GenBank Accession No. YP_005678263.1, "alcohol dehydrogenase [Clostridium botulinum H04402 065]," Dec. 24, 2012.
GenBank Accession No. YP_006390854.1, "aldehyde dehydrogenase [Thermoanaerobacterium saccharolyticum JW/SL-YS485]," Dec. 25, 2012.
GenBank Accession No. YP_006446580.1, "acetyl-CoA hydrolase [Desulfomonile tiedjei DSM 6799]," Dec. 24, 2012.
GenBank Accession No. YP_006466004.1, "acetyl-CoA hydrolase [Desulfosporosinus acidiphilus SJ4]," Jan. 10, 2013.
GenBank Accession No. YP_006466984.1, "acetyl-CoA hydrolase [Desulfosporosinus acidiphilus SJ4]," Jan. 10, 2013.
GenBank Accession No. YP_006513121.1, "aldehyde-alcohol dehydrogenase domain protein [Propionibacterium propionicum F0230a]," Dec. 24, 2012.
GenBank Accession No. YP_007299398.1, "NAD-dependent aldehyde dehydrogenase [Thermoanaerobacterium thermosaccharolyticum M0795]," Dec. 27, 2012.
GenBank Accession No. YP_007453510.1, "NADPH-dependent butanol dehydrogenase Adh [Clostridium saccharoperbutylacetonicum N1-4(HMT)]," Feb. 19, 2013.
GenBank Accession No. YP_007455800.1, "iron-containing alcohol dehydrogenase [Clostridium saccharoperbutylacetonicum N1-4(HMT)]," Feb. 19, 2013.
GenBank Accession No. YP_007458667.1, "NAD-dependent aldehyde dehydrogenase [Clostridium saccharoperbutylacetonicum N1-4(HMT)]," Feb. 19, 2013.
GenBank Accession No. YP_007781197.1, "Alcohol dehydrogenase, class IV [Ruminococcus bromii L2-63]," Apr. 15, 2013.
GenBank Accession No. YP_007783752.1, "NAD-dependent aldehyde dehydrogenases [*Ruminococcus* sp. SR1/5]," Apr. 15, 2013.
GenBank Accession No. YP_007787197.1, "Alcohol dehydrogenase, class IV [Ruminococcus torques L2-14]," Apr. 15, 2013.
GenBank Accession No. YP_007790855.1, "Alcohol dehydrogenase, class IV [butyrate-producing bacterium SSC/2]," Apr. 15, 2013.
GenBank Accession No. YP_007805199.1, "NAD-dependent aldehyde dehydrogenases [Ruminococcus obeum A2-162]," Apr. 15, 2013.
GenBank Accession No. YP_007825178.1, "Alcohol dehydrogenase, class IV [butyrate- producing bacterium SS3/4]," Apr. 15, 2013.
GenBank Accession No. YP_007848113.1, "Alcohol dehydrogenase, class IV [Clostridium cf. saccharolyticum K10]," Apr. 16, 2013.

(56) References Cited

OTHER PUBLICATIONS

GenBank Accession No. YP_007849785.1, "NAD-dependent aldehyde dehydrogenases [Clostridium cf. saccharolyticum K10]," Apr. 16, 2013.
GenBank Accession No. YP_426002.1, "aldehyde dehydrogenase [Rhodospirillum rubrum ATCC 11170]," Dec. 22, 2012.
GenBank Accession No. YP_695908.1, "NADPH-dependent butanol dehydrogenase [Clostridium butyricum 5521]," Nov. 9, 2010.
GenBank Accession No. YP_698587.1, "NADPH-dependent butanol dehydrogenase [Clostridium perfringens SM101]," Dec. 22, 2012.
GenBank Accession No. YP_878939.1, "NADPH-dependent butanol dehydrogenase [Clostridium novyi NT]," Dec. 22, 2012.
GenBank Accession No. ZP_00144049.1, "4-hydroxybutyrate:acetyl-CoA CoA transferase [Fusobacterium nucleatum subsp. vincentii ATCC 49256]," Nov. 11, 2010.
GenBank Accession No. ZP_01962381.1, "hypothetical protein RUMOBE_00094 [Ruminococcus obeum ATCC 29174]," Nov. 26, 2012.
GenBank Accession No. ZP_01969110.1, "hypothetical protein RUMTOR 02695 [Ruminococcus torques ATCC 27756]," Nov. 26, 2011.
GenBank Accession No. ZP_01994600.1, "hypothetical protein DORLON_00585 [Dorea longicatena DSM 13814]," Nov. 26, 2012.
GenBank Accession No. ZP_02036635.1, "hypothetical protein BACCAP_02245 [Bacteroides capillosus ATCC 29799]," May 28, 2011.
GenBank Accession No. ZP_02039809.1, "hypothetical protein RUMGNA_00563 [Ruminococcus gnavus ATCC 29149]," Nov. 9, 2010.
GenBank Accession No. ZP_02040258.1, "hypothetical protein RUMGNA 01022 [Ruminococcus gnavus ATCC 29149]," Nov. 9, 2010.
GenBank Accession No. ZP_02080962.1, "hypothetical protein CLOLEP_02428 [Clostridium leptum DSM 753]," Nov. 26, 2012.
GenBank Accession No. ZP_02083621.1, "hypothetical protein CLOBOL_01144 [Clostridium bolteae Atcc BAA-613]," Nov. 26, 2012.
GenBank Accession No. ZP_02089671.1, "hypothetical protein CLOBOL_07248 [Clostridium bolteae Atcc BAA-613]," Nov. 26, 2012.
GenBank Accession No. ZP_02234621.1, "hypothetical protein DORFOR_01493 [Dorea formicigenerans ATCC 27755]," Nov. 9, 2010.
GenBank Accession No. ZP_02417601.1, "hypothetical protein ANACAC_00165 [Anaerostipes caccae DSM 14662]," Nov. 27, 2012.
GenBank Accession No. ZP_02419256.1, "hypothetical protein ANACAC_01842 [Anaerostipes caccae DSM 14662]," Nov. 27, 2012.
GenBank Accession No. ZP_02440114.1, "hypothetical protein CLOSS21_02605 [Clostridium sp. SS2/1]," Nov. 27, 2012.
GenBank Accession No. ZP_02614964.1, "NADH-dependent butanol dehydrogenase [Clostridium botulinum NCTC 2916]," Dec. 9, 2010.
GenBank Accession No. ZP_02619369.1, "NADH-dependent butanol dehydrogenase [Clostridium botulinum Bf]," Dec. 9, 2010.
GenBank Accession No. ZP_02620674.1, "NADPH-dependent butanol dehydrogenase [Clostridium botulinum C str. Eklund]," Dec. 9, 2010.
GenBank Accession No. ZP_02631505.2, NADPH-dependent butanol dehydrogenase [Clostridium perfringens E str. JGS1987], Dec. 10, 2010.
GenBank Accession No. ZP_02635244.2, "NADPH-dependent butanol dehydrogenase [Clostridium perfringens B str. ATCC 3626]," Dec. 10, 2010.
GenBank Accession No. ZP_02638669.1, "NADPH-dependent butanol dehydrogenase [Clostridium perfringens CPE str. F4969]," Dec. 10, 2010.
GenBank Accession No. ZP_02642725.2, "NADPH-dependent butanol dehydrogenase [Clostridium perfringens NCTC 8239]," Dec. 10, 2010.
GenBank Accession No. ZP_02862002.1, "hypothetical protein ANASTE_01215 [Anaerofustis stercorihominis DSM 17244]," Nov. 27, 2012.
GenBank Accession No. ZP_02864967.1, "NADPH-dependent butanol dehydrogenase [Clostridium perfringens C str. JGS1495]," Nov. 9, 2010.
GenBank Accession No. ZP_02950012.1, "NADPH-dependent butanol dehydrogenase [Clostridium butyricum 5521]," Nov. 9, 2010.
GenBank Accession No. ZP_02950013.1, "NADPH-dependent butanol dehydrogenase [Clostridium butyricum 5521]," Nov. 9, 2010.
GenBank Accession No. ZP_02952006.1, "NADPH-dependent butanol dehydrogenase [Clostridium perfringens D str. JGS1721]," Nov. 10, 2010.
GenBank Accession No. ZP_02996149.1, hypothetical protein CLOSPO_03272 [Clostridium sporogenes ATCC 15579], Nov. 27, 2012.
GenBank Accession No. ZP_03168412.1, "hypothetical protein RUMLAC_02095 [Ruminococcus lactaris ATCC 29176]," Nov. 27, 2012.
GenBank Accession No. ZP_03289399.1, "hypothetical protein CLONEX_01601 [Clostridium nexile DSM 1787]," Nov. 27, 2012.
GenBank Accession No. ZP_03705305.1, "hypothetical protein CLOSTMETH_00016 [Clostridium methylpentosum DSM 5476]," Nov. 27, 2012.
GenBank Accession No. ZP_03715465.1, "propionaldehyde dehydrogenase [[Clostridium] bolteae 90B8]," Apr. 19, 2013.
GenBank Accession No. ZP_03758198.1, "hypothetical protein CLOSTASPAR 02210 [Clostridium asparagiforme DSM 15981]," Nov. 27, 2012.
GenBank Accession No. ZP_03760651.1, "hypothetical protein CLOSTASPAR 04682 [Clostridium asparagiforme DSM 15981],".
GenBank Accession No. ZP_04054791.1, "4-hydroxybutyrate coenzyme A transferase [Porphyromonas uenonis 60-3]," Nov. 10, 2010.
GenBank Accession No. ZP_04389695.1, "4-hydroxybutyrate coenzyme A transferase [Porphyromonas endodontalis ATCC 35406]," Nov. 10, 2010.
GenBank Accession No. ZP_04454656.1, "hypothetical protein GCWU000342_00651 [Shuttleworthia satelles DSM 14600]," Nov. 27, 2012.
GenBank Accession No. ZP_04572117.1, "4-hydroxybutyrate:acetyl-CoA transferase [*Fusobacterium* sp. 4_1_13]," Jun. 9, 2010.
GenBank Accession No. ZP_04572671.1, "4-hydroxybutyrate coenzyme A transferase [*Fusobacterium* sp. 4_1_13]," Jun. 9, 2010.
GenBank Accession No. ZP_04573939.1, "ethanolamine utilization protein eutE [*Fusobacterium* sp. 7 1]," Jun. 9, 2010.
GenBank Accession No. ZP_04575154.1, "4-hydroxybutyrate coenzyme A transferase [*Fusobacterium* sp. 7_1]," Jun. 9, 2010.
GenBank Accession No. ZP_04668388.1, "iron-containing alcohol dehydrogenase [Clostridiales bacterium 1 7 47 FAA]," Jun. 8, 2010.
GenBank Accession No. ZP_04822415.1, "NADH-dependent butanol dehydrogenase [Clostridium botulinum El str. 'BoNT E Beluga']," Nov. 10, 2010.
GenBank Accession No. ZP_04822936.1, "ethanolamine utilization protein EutE [Clostridium botulinum El str. 'Bont E Beluga']," Nov. 10, 2010.
GenBank Accession No. ZP_04856816.1, "aldehyde dehydrogenase [*Ruminococcus* sp. 5 1 39B FAA]," Jun. 9, 2010.
GenBank Accession No. ZP_04861753.1, "NADPH-dependent butanol dehydrogenase [Clostridium botulinum D str. 1873]," Nov. 10, 2010.
GenBank Accession No. ZP_04969437.1, "possible aldehyde dehydrogenase [*Fusobacterium nucleatum* subsp. polymorphum ATCC 10953]," Jan. 1, 2011.
GenBank Accession No. ZP_04971624.1, "acetyl-CoA hydrolase [Fusobacterium nucleatum subsp. polymorphum ATCC 10953]," Jan. 1, 2011.
GenBank Accession No. ZP_05351533.1, "4-hydroxybutyrate CoA transferase [Clostridium difficile ATCC 43255]," Nov. 26, 2012.
GenBank Accession No. ZP_05391061.1, "Aldehyde Dehydrogenase [Clostridium carboxidivorans P7]," Nov. 10, 2010.

(56) References Cited

OTHER PUBLICATIONS

GenBank Accession No. ZP_05391085.1, "iron-containing alcohol dehydrogenase [Clostridium carboxidivorans P7]," Nov. 10, 2010.
GenBank Accession No. ZP_05392917.1, "iron-containing alcohol dehydrogenase [Clostridium carboxidivorans P7]," Nov. 10, 2010.
GenBank Accession No. ZP_05393683.1, "iron-containing alcohol dehydrogenase [Clostridium carboxidivorans P7]," Nov. 10, 2010.
GenBank Accession No. ZP_05393779.1, "Aldehyde Dehydrogenase [Clostridium carboxidivorans P7]," Nov. 10, 2010.
GenBank Accession No. ZP_05395303.1, "acetyl-CoA hydrolase/transferase [Clostridium carboxidivorans P7]," Nov. 10, 2010.
GenBank Accession No. ZP_05401721.1, "4-hydroxybutyrate CoA transferase [Clostridium difficile QCD-23m63]," Nov. 26, 2012.
GenBank Accession No. ZP_05427217.1, "4-hydroxybutyrate CoA-transferase [Eubacterium saphenum ATCC 49989]," Nov. 27, 2012.
GenBank Accession No. ZP_05550423.1, "4-hydroxybutyrate:acetyl-CoA transferase [*Fusobacterium* sp. 3_1_36A2]," Jun. 9, 2010.
GenBank Accession No. ZP_05550921.1, "acetyl-CoA hydrolase [*Fusobacterium* sp. 3 1 36A2]," Jun. 9, 2010.
GenBank Accession No. ZP_05814664.1, "acetyl-CoA hydrolase [*Fusobacterium* sp. 3_1_33]," Jun. 9, 2010.
GenBank Accession No. ZP_05815063.1, "acetaldehyde dehydrogenase (acetylating) [*Fusobacterium* sp. 3_1_33]," Jun. 9, 2010.
GenBank Accession No. ZP_06027623.1, "4-hydroxybutyrate CoA-transferase [Fusobacterium periodonticum ATCC 33693]," Nov. 27, 2012.
GenBank Accession No. ZP_06115415.1, "NADPH-dependent butanol dehydrogenase [Clostridium hathewayi DSM 13479]," Nov. 27, 2012.
GenBank Accession No. ZP_06346636.2, "NADPH-dependent butanol dehydrogenase [*Clostridium* sp. M62/1]," Nov. 27, 2012.
GenBank Accession No. ZP_06524378.1, "ethanolamine utilization protein eutE [*Fusobacterium* sp. D11]," Jun. 9, 2010.
GenBank Accession No. ZP_06559383.1, "acetyl-CoA hydrolase/transferase [Megasphaera genomosp. type_1 str. 28L]," Nov. 10, 2010.
GenBank Accession No. ZP_06747486.1, "4-hydroxybutyrate CoA-transferase [*Fusobacterium* sp. 1_1_41FAA]," Sep. 22, 2011.
GenBank Accession No. ZP_06748808.1, "CoA-dependent propionaldehyde dehydrogenase [*Fusobacterium* sp. 1_1_41FAA]," Jun. 10, 2010.
GenBank Accession No. ZP_06750521.1, "4-hydroxybutyrate CoA-transferase [*Fusobacterium* sp. 3_1_27]," Sep. 22, 2011.
GenBank Accession No. ZP_06853946.1, "putative NADPH-dependent butanol dehydrogenase [Clostridium carboxidivorans P7]," Dept. 22, 2011.
GenBank Accession No. ZP_06983177.1, "4-hydroxybutyrate CoA-transferase [Bacteroidetes oral taxon 274 str. F0058]," Jun. 16, 2010.
GenBank Accession No. ZP_07453625.1, "CoA-dependent propionaldehyde dehydrogenase [*Eubacterium yurii* subsp. margaretiae ATCC 43715]," Nov. 27, 2012.
GenBank Accession No. ZP_07455129.1, "4-hydroxybutyrate CoA-transferase [*Eubacterium yurii* subsp. margaretiae ATCC 43715]," Nov. 27, 2012.
GenBank Accession No. ZP_07821110.1, "4-hydroxybutyrate coenzyme A transferase [Porphyromonas asaccharolytica PR426713P-I]," Dec. 10, 2010.
GenBank Accession No. ZP_07914775.1, "4-hydroxybutyrate:acetyl-CoA transferase [Fusobacterium gonidiaformans ATCC 25563]," Jan. 1, 2011.
GenBank Accession No. ZP_07924174.1, "4-hydroxybutyrate:acetyl-CoA transferase [*Fusobacterium* sp. 3_1_5R]," Jan. 6, 2011.
GenBank Accession No. ZP_07932276.1, "acetyl-CoA hydrolase/transferase domain-containing protein [*Anaerostipes* sp. 3_2_56FAA]," Nov. 27, 2012.
GenBank Accession No. ZP_07932949.1, "iron-containing alcohol dehydrogenase [*Anaerostipes* sp. 3_2_56FAA]," Nov. 27, 2012.

GenBank Accession No. ZP_07957621.1, "iron-containing alcohol dehydrogenase [Lachnospiraceae bacterium 5_1_63FAA]," Nov. 27, 2012.
GenBank Accession No. ZP_07958427.1, "NADPH-dependent butanol dehydrogenase [Lachnospiraceae bacterium 8_1 57FAA]," Nov. 27, 2012.
GenBank Accession No. ZP_08089122.1, "acetyl-CoA hydrolase/transferase [Clostridium symbiosum WAL-14163]," Nov. 27, 2012.
GenBank Accession No. ZP_08106938.1, "acetyl-CoA hydrolase/transferase [Clostridium symbiosum WAL-14673]," Nov. 27, 2012.
GenBank Accession No. ZP_08130302.1, "CoA-dependent propionaldehyde dehydrogenase [*Clostridium* sp. D5]," Nov. 15, 2011.
GenBank Accession No. ZP_08130603.1, "NADPH-dependent butanol dehydrogenase [*Clostridium* sp. D5]," Nov. 15, 2011.
GenBank Accession No. ZP_08150110.1, "NADPH-dependent butanol dehydrogenase [Lachnospiraceae bacterium 4_1_37FAA]," Nov. 27, 2012.
GenBank Accession No. ZP_08331580.1, "NADPH-dependent butanol dehydrogenase [Lachnospiraceae bacterium 6_1_63FAA]," Nov. 27, 2012.
GenBank Accession No. ZP_08334039.1, "NADPH-dependent butanol dehydrogenase [Lachnospiraceae bacterium 9_1_43BFAA]," Nov. 27, 2012.
GenBank Accession No. ZP 08339921.1, "NADPH-dependent butanol dehydrogenase [Lachnospiraceae bacterium 2_1_46FAA]," Nov. 27, 2012.
GenBank Accession No. ZP_08533507.1, "Aldehyde Dehydrogenase [Caldalkalibacillus thermarum TA2.Al]," Jun. 7, 2011.
GenBank Accession No. ZP_08581574.1, "hypothetical protein HMPREF0404 00865 [*Fusobacterium* sp. 21_1A]," Nov. 27, 2012.
GenBank Accession No. ZP_08598358.1, "4-hydroxybutyrate CoA-transferase [*Fusobacterium* sp. 11_3_2]," Nov. 27, 2012.
GenBank Accession No. ZP_08598403.1, 4-hydroxybutyrate CoA-transferase [*Fusobacterium* sp. 11 3 2],' Nov. 27, 2012.
GenBank Accession No. ZP_08600044.1, "CoA-dependent propionaldehyde dehydrogenase [*Fusobacterium* sp. 11_3_2]," Nov. 27, 2012.
GenBank Accession No. ZP_08607032.1, "hypothetical protein HMPREF0994 03038 [Lachnospiraceae bacterium 3_1_57FAA_CT1]," Nov. 27, 2012.
GenBank Accession No. ZP_08612821.1, "hypothetical protein HMPREF0991_01940 [Lachnospiraceae bacterium 2_1_58FAA]," Nov. 27, 2012.
GenBank Accession No. ZP_08614635.1, NADPH-dependent butanol dehydrogenase [Lachnospiraceae bacterium 1_4_56FAA], Nov. 27, 2012.
GenBank Accession No. ZP_08616478.1, "hypothetical protein HMPREF0988_02063 [Lachnospiraceae bacterium 1 4 56FAA]," Nov. 27, 2012.
GenBank Accession No. ZP_08623452.1, "acetyl-CoA hydrolase/transferase [Acetonema longum DSM 6540]," Jun. 29, 2011.
GenBank Accession No. ZP_08623980.1, "aldehyde dehydrogenase EutE [Acetonema longum DSM 6540]," Jun. 29, 2011.
GenBank Accession No. ZP_08689706.1, "4-hydroxybutyrate coenzyme A transferase [*Fusobacterium* sp. 2_1_31]," Nov. 27, 2012.
GenBank Accession No. ZP_08691841.1, "4-hydroxybutyrate coenzyme A transferase [*Fusobacterium* sp. D12]," Nov. 27, 2012.
GenBank Accession No. ZP_08693593.1, "ethanolamine utilization protein eutE [Fusobacterium varium ATCC 27725]," Nov. 27, 2012.
GenBank Accession No. ZP_08693772.1, "4-hydroxybutyrate coenzyme A transferase [Fusobacterium varium ATCC 27725]," Nov. 27, 2012.
GenBank Accession No. ZP_08710943.1, "4-hydroxybutyrate coenzyme A transferase [*Megasphaera* sp. UPII 135-E]," Aug. 1, 2011.
GenBank Accession No. ZP_08814704.1, "aldehyde dehydrogenase family protein [*Desulfosporosinus* sp. OT]," Sept. 9, 2011.
GenBank Accession No. ZP_08848505.1, "NADPH-dependent butanol dehydrogenase [Dorea formicigenerans 4_6_53AFAA]," Nov. 27, 2012.
GenBank Accession No. ZP_08935544.1, "4-hydroxybutyrate CoA-transferase [Peptoniphilus indolicus ATCC 29427]," Nov. 27, 2012.

(56) References Cited

OTHER PUBLICATIONS

GenBank Accession No. ZP_08976459.1, "acetyl-CoA hydrolase/transferase [Desulfitobacterium metallireducens DSM 15288]," Oct. 27, 2011.
GenBank Accession No. ZP_09046738.1, "4-hydroxybutyrate coenzyme A transferase [*Clostridium* sp. 7_3_54FAA]," Nov. 27, 2012.
GenBank Accession No. ZP_09058579.1, "NADPH-dependent butanol dehydrogenase [Clostridium citroniae WAL-17108]," Nov. 27, 2012.
GenBank Accession No. ZP_09116578.1, "hypothetical protein HMPREF9467_03550 [Clostridium clostridioforme 2_1_49FAA]," Nov. 27, 2012.
GenBank Accession No. ZP_09116768.1, "NADPH-dependent butanol dehydrogenase [Clostridium clostridioforme 2 1 49FAA]," Nov. 27, 2012.
GenBank Accession No. ZP_09202750.1, "Alcohol dehydrogenase [*Clostridium* sp. DL-VIII]," Dec. 6, 2011.
GenBank Accession No. ZP_09206127.1, "Acetaldehyde dehydrogenase (acetylating) [*Clostridium* sp. DL-VIII]," Dec. 6, 2011.
GenBank Accession No. ZP_09316712.1, "hypothetical protein HMPREF9628_01348 [Eubacteriaceae bacterium CM5]," Nov. 27, 2012.
GenBank Accession No. ZP_09320518.1, "hypothetical protein HMPREF9629 00032 [Eubacteriaceae bacterium ACC19a]," Nov. 27, 2012.
GenBank Accession No. ZP_09360726.1, "hypothetical protein HMPREF1006_02359 [*Synergistes* sp. 3 1 syn1], " Nov. 14, 2012.
GenBank Accession No. ZP_09382538.1, "NADPH-dependent butanol dehydrogenase [Flavonifractor plautii ATCC 29863]," Nov. 27, 2012.
GenBank Accession No. ZP_09385293.1, "putative butyryl-CoA:acetate CoA-transferase [Flavonifractor plautii ATCC 29863]," Nov. 27, 2012.
GenBank Accession No. ZP_09385796.1, "aldehyde dehydrogenase family protein [Flavonifractor plautii ATCC 29863]," Nov. 27, 2012.
GenBank Accession No. ZP_09533821.1, "hypothetical protein HMPREF0995_04657 [Lachnospiraceae bacterium 7_1_58FAA]," Nov. 27, 2012.
GenBank Accession No. ZP_09534466.1, "hypothetical protein HMPREF0995 05302 [Lachnospiraceae bacterium 7_1_58FAA]," Nov. 27, 2012.
GenBank Accession No. ZP_09586344.1, "hypothetical protein HMPREF0402_00217 [*Fusobacterium* sp. 12_1B]," Nov. 27, 2012.
GenBank Accession No. ZP_09586735.1, "hypothetical protein HMPREF0402_00608 [*Fusobacterium* sp. 12_1B]," Nov. 27, 2012.
GenBank Accession No. ZP_09999308.1, " 4-hydroxybutyrate CoA-transferase [Imtechella halotolerans K1]," Apr. 12, 2012.
GenBank Accession No. ZP_10305985.1, "Low Quality Protein: acetyl-CoA hydrolase [Thermoanaerobacter siderophilus SR4]," Jun. 27, 2012.
GenBank Accession No. ZP_10325539.1, "acetyl-CoA hydrolase/transferase [Pelosinus fermentans DSM 17108]," Jun. 27, 2012.
GenBank Accession No. ZP_10327808.1, "Aldehyde Dehydrogenase [Pelosinus fermentans DSM 17108]," Jun. 27, 2012.
GenBank Accession No. ZP_10774427.1, "hypothetical protein CarbS_08493 [Clostridium arbusti SL206]," Aug. 8, 2012.
GenBank Accession No. ZP_10775305.1, "hypothetical protein CarbS_12961 [Clostridium arbusti SL206]," Aug. 8, 2012.
GenBank Accession No. ZP_10828060.1, "aldehyde dehydrogenase (NAD) domain protein [Eubacterium sp. AS15]," Aug. 27, 2012.
GenBank Accession No. ZP_10829831.1, "4-hydroxybutyrate coenzyme A transferase [*Eubacterium* sp. AS15]," Aug. 27, 2012.
GenBank Accession No. ZP_10886417.1, "aldehyde dehydrogenase (NAD) family protein [Eubacteriaceae bacterium OBRC8]," Sept. 4, 2012.
GenBank Accession No. ZP_10929454.1, "NADH-dependent butanol dehydrogenase [*Clostridium* sp. JC122]," Nov. 27, 2012.
GenBank Accession No. ZP_10973595.1, "hypothetical protein FUAG_02467 [Fusobacterium ulcerans ATCC 49185]," Nov. 27, 2012.
GenBank Accession No. ZP_10974295.1, "hypothetical protein FUAG_00592 [Fusobacterium ulcerans ATCC 49185]," Nov. 27, 2012.
GenBank Accession No. ZP_10977308.1, "NADPH-dependent butanol dehydrogenase [*Clostridium* sp. 7_2_43FAA]," Nov. 27, 2012.
GenBank Accession No. ZP_11313951.1, "aldehyde dehydrogenase EutE [Bacillus azotoformans LMG 9581]," Nov. 1, 2012.
GenBank Accession No. ZP_11366418.1, "alcohol dehydrogenase, class IV [*Clostridium* sp. Maddingley MBC34-26]," Nov. 5, 2012.
GenBank Accession No. ZP_14365187.1, "4-hydroxybutyrate coenzyme A transferase [*Fusobacterium necrophorum* subsp. funduliforme ATCC 51357]," Nov. 17, 2012.
GenBank Accession No. ZP_14663205.1, "4-hydroxybutyrate coenzyme A transferase [*Clostridium* sp. MSTE9]," Nov. 17, 2012.
GenBank Accession No. ZP_14663848.1, "aldehyde dehydrogenase (NAD) domain protein [*Clostridium* sp. MSTE9]," Nov. 17, 2012.
GenBank Accession No. ZP_14664473.1, "4-hydroxybutyrate coenzyme A transferase [*Clostridium* sp. MSTE9]," Nov. 17, 2012.
GenBank Accession No. ZP_15516677.1, "acetyl-CoA hydrolase/transferase [Pelosinus fermentans B4]," Nov. 18, 2012.
GenBank Accession No. ZP_15537951.1, "Aldehyde Dehydrogenase [Pelosinus fermentans JBW45]," Nov. 18, 2012.
GenBank Accession No. ZP_15604676.1, "4-hydroxybutyrate CoA-transferase [*Fusobacterium nucleatum* subsp. fusiforme ATCC 51190]," Nov. 18, 2012.
GenBank Accession No. ZP_15972610.1, "aldehyde dehydrogenase EutE [Fusobacterium nucleatum ChDC F128]," Nov. 18, 2012.
GenBank Accession No. ZP_15973607.1, "4-hydroxybutyrate CoA-transferase [Fusobacterium nucleatum ChDC F128]," Nov. 18, 2012.
GenBank Accession No. ZP_16269747.1, "NADH-dependent butanol dehydrogenase, partial [Clostridium botulinum CFSAN001627]," Nov. 18, 2012.
GenBank Accession No. ZP_16419680.1, "CoA-dependent propionaldehyde dehydrogenase [*Fusobacterium nucleatum* subsp. polymorphum F0401]," Nov. 27, 2012.
GenBank Accession No. ZP_16420483.1, "4-hydroxybutyrate CoA-transferase [*Fusobacterium nucleatum* subsp. polymorphum F0401]," Nov. 27, 2012.
GenBank Accession No. ZP_16426838.1, "hypothetical protein HMPREF9476_00911 [Clostridium perfringens WAL-14572]," Nov. 27, 2012.
GenBank Accession No. ZP_16920614.1, "NADPH-dependent butanol dehydrogenase [Clostridium perfringens F262]," Nov. 27, 2012.
GenBank Accession No. ZP_16968033.1, "4-hydroxybutyrate CoA-transferase [*Fusobacterium nucleatum* subsp. animalis ATCC 51191]," Nov. 21, 2012.
GenBank Accession No. ZP_17072579.1, "putative butyryl-CoA:acetate CoA-transferase [Clostridium difficile 002-P50-2011]," Nov. 27, 2012.
GenBank Accession No. ZP_17124213.1, "hypothetical protein HMPREF9942 00351 [*Fusobacterium nucleatum* subsp. animalis F0419]," Nov. 27, 2012.
GenBank Accession No. ZP_17125059.1, "hypothetical protein HMPREF9942 01197 [*Fusobacterium nucleatum* subsp. animalis F0419]," Nov. 27, 2012.
GenBank Accession No. ZP_17694107.1, "ethanolamine utilization protein eutE [Geobacillus thermoglucosidans TNO-09.020]," Nov. 27, 2012.
GenBank Accession No. ZP_18252471.1, "NADH-dependent butanol dehydrogenase [Clostridium sporogenes PA 3679]," Nov. 28, 2012.
GenBank Accession No. ZP_19296595.1, "aldehyde dehydrogenase family protein [Clostridium celatum DSM 1785]," Jan. 30, 2013.
GenBank Accession No. ZP_19299687.1, "NADPH-dependent butanol dehydrogenase [Clostridium celatum DSM 1785]," Jan. 30, 2013.
GenBank Accession No. ZP_23773859.1, "CoA-acylating propionaldehyde dehydrogenase [*Halanaerobium saccharolyticum* subsp. saccharolyticum DSM 6643]," Mar. 25, 2013.
Gerhardt et al., "Fermentation of 4-aminobutyrate by Clostridium aminobutyricum: cloning of two genes involved in the formation and dehydration of 4-hydroxybutyryl-CoA," Arch. Microbiol., 174:189-199 (2000).

(56) References Cited

OTHER PUBLICATIONS

Gibbs et al., "Degenerate oligonucleotide gene shuffling (DOGS): a method for enhancing the frequency of recombination with family shuffling," Gene, 271:13-20 (2001).

Giesel et al., "On the occurrence of enoate reductase and 2-oxo-carboxylate reductase in clostridia and some observations on the amino acid fermentation by Peptostreptococcus anaerobius," Arch. Microbiol., 135(1):51-57 (1983).

Goda et al., "Cloning, Sequencing, and Expression in Escherichia coli of the Clostridium tetanomorphum Gene Encoding B-Methylaspartase and Characterization of the Recombinant Protein," Biochemistry, 31:10747-10756 (1992).

Gong et al., "Specificity Determinants for the Pyruvate Dehydrogenase Component Reaction Mapped with Mutated and Prosthetic Group Modified Lipoyl Domains," J. Biol. Chem., 275(18):13645-13653 (2000).

Gonzalez-Pajuelo et al., "Metabolic engineering of Clostridium acetobutylicum for the industrial production of 1,3-propanediol from glycerol," Met. Eng., 7:329-336 (2005).

Goupil et al., "Imbalance of leucine flux in Lactoccus lactis and its use for the isolation of diacetyl-overproducing strains," Appl. Environ. Microbiol., 62(7):2636-2640 (1996).

Goupil-Feuillerat et al., "Transcriptional and translational regulation of alpha-acetolactate decarboxylase of Lactococcus lactis subsp. Lactis," J. Bacteriol., 182(19):5399-5408 (2000).

Green et al., "Catabolismof a-Ketoglutarate by a sucA Mutant of Bradyrhizobium japonicum: Evidence for an Alternative Tricarboxylic Acid Cycle," J. Bacteriol., 182(10):2838-2844 (2000).

Guirard et al., "Purification and properties of ornithine decarboxylase from Lactobacillus sp. 30a," J. Biol. Chem., 255(12):5960-5964 (1980).

Guo et al., "Posttranslational activation, site-directed mutation and phylogenetic analyses of lysine biosynthesis enzymes alpha-aminoadipate reductase Lys1P (AARO and the phosphopantetheinyl transferase Lys7p (PPTase) from Schizosaccharomyces pombe," Yeast, 21(15):1279-1288 (2004).

Guo et al., "Site-directed mutational analysis of the novel catalytic domains of alpha-aminoadipate reductase (Lys2p) from Candida albicans," Mol. Genet. Genomics, 269(2):271-279 (2003).

Hadfield et al., "Active site analysis of the potential antimicrobial target aspartate semialdehyde dehydrogenase," Biochemistry, 40(48):14475-14483 (2001).

Hadfield et al., "Structure of aspartate-beta-semialdehyde dehydrogenase from Escherichia coli, a key enzyme in the aspartate family of amino acid biosynthesis," J. Mol. Biol., 289(4):991-1002 (1999).

Hammer et al., "Purification and characterization of an inducible L-lysine:2-oxoglutarate 6- aminostransferase from Dandida utilis," J. Basic Microbiol., 32:21-27 (1992).

Hanai et al., "Engineered synthetic pathway for isopropanol production in Escherichia coli," Appl. Environ. Microbiol., 73:7814-7818 (2007).

Hansen et al., "The effect of the lacY gene on the induction of IPTG inducible promoters, studied in Escherichia coli and pseudomonas fluorescens," Curr. Microbiol., 36(6):341-347 (1998).

Hansford, "Control of mitochondrial substrate oxidation," Curr. Top. Bioenerg., 10:217-278 (1980).

Hasegawa et al., "Transcriptional regulation of ketone body-utilizing enzyme, acetoacetyl-CoA synthetase, by C/EBPα during adipocyte differentiation," Biochim. Biophys. Acta, 1779:414-419 (2008).

Hashidoko et al., "Cloning of a DNA Fragment Carrying the 4-Hydroxycinnamate Decarboxylase (pofK) Gene from Klebsiella oxtoca, and Its Constitutive Expression in Escherichia coli JM109 Cells," Biosci. Biotech. Biochem., 58(1):217-218 (1994).

Hashimoto et al., "Activation of L-Lysine ε-Dehydrogenase from Agrobacterium tumefaciens by Several Amino Acids and Monocarboxylates," J. Biochem., 106:76-80 (1989).

Hasson et al., "The Crystal Structure of Benzoylformate Decarboxylase at 1.6 Å Resolution: Diversity of Catalytic Residues in thiamin Diphosphate-Dependent Enzymes," Biochemistry 37:9918-9930 (1998).

Hawes et al., "Mammalian 3-hydroxyisobutyrate dehydrogenase," Methods Enzymol., 324:218- 228 (2000).

Hayashi et al., "Purification of NADH-ferricyanide dehydrogenase and NADH-quinone reductase from Escherichia coli membranes and their roles in the respiratory chain," Biochim. Biophys. Acta, 977:62-69 (1989).

Hayden et al., "Glutamate dehydrogenase of Halobacterium salinarum: evidence that the gene sequence currently assigned to the NADP+-dependent enzyme is in fact that of the NAD+-dependent glutamate dehydrogenase," FEMS Microbiol. Lett., 211:37-41 (2002).

Hayes et al., "Combining computational and experimental screening for rapid optimization of protein properties," Proc. Natl. Acad. Sci. U.S.A., 99(25):15926-15931 (2002).

Hayes, "Transposon-Based Strategies for Microbial Functional Genomics and Proteomics," Annu. Rev. Genet., 37:3-29 (2003).

Henne, et al., "Construction of environmental DNA libraries in Escherichia coli and screening for the presence of genes conferring utilization of 4-hydroxybutyrate," Appl. Environ. Microbiol., 65(9):3901-3907 (1999).

Hennessy, et al., "The reactivity of gamma-hydroxybutyric acid (GHB) and gamma-butyrolactone (GBL) in alcoholic solutions," J. Forensic. Sci., 49(6):1220-1229 (2004).

Henning et al., "Identification of Novel enzoylformate Decarboxlyases by Growth Selection," App. Environ. Microbiol., 72(12)7510-7517 (2006).

Hermes et al., "Searching sequence space by definably random mutagenesis: Improving the catalytic potency of an enzyme," Proc. Natl. Acad. Sci. U.S.A., 87:696-700 (1990).

Herrmann et al., "Two beta-alanyl-CoA: ammonia lyases in Clostridium propionicum," FEBS J., 272:813-821 (2005).

Hesslinger et al., "Novel keto acid formate-lyase and propionate kinase enzymes are components of an anaerobic pathway in Escherichia coli that degrades L-threonine to propionate," Mol. Microbiol., 27:477-492 (1998).

Hester et al., "Purification of active El alpha 2 beta 2 of Pseudomonas putida branched-chain- oxoacid dehydrogenase," Eur. J. Biochem., 233(3):828-836 (1995).

Heydari et al., "Highly Stable L-Lysine 6-Dehydrogenase from the Thermophile Geobacillus stearothemophilus Isolated from a Japanese Hot Spring: Characterization, gene Cloning and Sequencing, and Expression," Appl. Environ. Microbiol., 70:937-942 (2004).

Hibbert et al. "Directed evolution of biocatalytic processes," Biomol. Eng., 22:11-19 (2005).

Hijarrubia et al., "Domain Structure characterization of the Multifunctional α-Aminoadipate Reductase from Penicillium chrysogenum by Limited Proteolysis," J. Biol. Chem., 278:8250-8256 (2003).

Hirano et al., "Purification and Characterization of the alcohol dehydrogenase with a broad substrate specificity originated from 2-phenylethanol-assimilating Brevibacterium sp. KU 1390," J. Biosci. Bioeng., 100(3):318-322 (2005).

Hochstrasser, "Ubiquitin-Dependent Protein Degradation," Annu. Rev. Genet., 30:405-439 (1996).

Hoffmeister et al., "Mitochondrial trans-2-enoyl-CoA reductase of wax ester fermentation from Euglena gracilis defines a new family of enzymes involved in lipid synthesis," J. Biol. Chem., 280:4329-4338 (2005).

Hogan et al., "Improved specificity toward substrates with ositively charged side chains by site-directed mutagenesis of the L-lactate dehydrogenase of Bacillus stearothermophilus," Biochemistry, 34(13):4225-4230 (1995).

Hong et al., "Enhanced Production of Succinic Acid by Metabolically Engineered Escherichia coli with Amplified Activities of Malic Enzyme and Fumarase," Biotechnol. Bioprocess Eng., 9:252-255 (2004).

Houseley et al., "The Many Pathways of RNA Degradation," Cell, 136(4):763-776 (2009).

Huang et al., "Identification and Characterization of a Second Butyrate Kinase from Clostridium acetobutylicum ATCC 824, " J. Mol. Microbiol. Biotechnol., 2(1):33-38 (2000).

Huang et al., "Purificatiokillenn and Characterization of a Ferulic Acid Decarboxylase from Pseudomonas fluorescens," J. Bacteriol., 176(19):5912-5918 (1994).

(56) References Cited

OTHER PUBLICATIONS

Hughes et al., "Evidence for Isofunctional Enzymes in the Degradation of Phenol, m- and p- Toulate, and p-Cresol via Catechol meta-Cleavage Pathways in Alcaligenes eutrophus," *J. Bacteriol.*, 158:79-83 (1984).
Hugler et al., "Malonyl-coenzyme A reductase from Chloroflexus aurantiacus, a key enzyme of the 3-hydroxypropionate cycle for autotrophic CO(2) fixation," *J.Bacteriol.*, 184:2404-2410 (2002).
Huh et al., "Global analysis of protein localization in budding yeast," *Nature*, 425:686-691 (2003).
Huisman et al., "Enzyme Evolution for Chemical Process Applications," *Biocatalysis in the Pharmaceutical and Biotechnology Industries*, R N. Patel (ed.), CRC Press, Boca Raton, FL, Chapter 30, pp. 717-742 (2007).
Huo et al., "Substrate specificity and identification of functional groups of homoserine kinase from *Escherichia col*," *Biochemistry*, 35(50):16180-16185 (1996).
Ibarra et al., "*Escherichia coli* K-12 undergoes adaptive evolution to achieve in silico predicted optimal growth," *Nature*, 420(6912):186-189 (2002).
Iffland et al., "Directed molecular evolution of cytochrome c peroxidase," *Biochemistry*, 39(25):10790-10798 (2000).
Ikai et al., "Identification and Analysis of a Gene Encoding L-2,4-Diaminobutyrate:2- Ketoglutarate 4-Aminotransferase Invloved in the 1,3-Diaminopropane Production Pathway in Acinetobacter baumanni," *J. Bacteriol.*, 179(16):5118-5125 (1997).
Ingoldsby et al., "The discovery of four distinct glutamate dehydrogenase genes in a strain of Halobacterium salinarum," *Gene*, 349:237-244 (2005).
Ishige et al., "Wax ester production from n-alkanes by *Acinetobacter* sp. strain M-1: ultrastructure of cellular inclusions and role of acyl coenzyme A reductase," *Appl. Environ. Microbiol.*, 68(3): 1192-1195 (2002).
Ismaiel et al., "Purification and characterization of a primary-secondary alcohol dehydrogenase from two strains of Clostridium beijerinckii," *J. Bacteriol.*, 175(16):5097-5105 (1993).
Ismail et al., "Functional genomics by NMR spectroscopy Phenylacetate catabolism in *Escherichia coli*," *Eur. J. Biochem.*, 270:3047-3054 (2003).
Iuchi et al., "arcA (dye), a global regulatory gene in *Escherichia coli* mediating repression of enzymes in aerobic pathways," *Proc. Natl. Acad. Sci. USA*, 85:1888-1892 (1988).
Jeon et al., "Heterologous expression of the alcohol dehydrogenase (adhI) gene from Geobacillus thermoglucosidasius strain M10EXG," *J. Biotechnol.*, 135:127-133 (2008).
Jewell et al., "Bioconversion of propionic, valeric and 4-hydroxybutyric acids into the corresponding alcohols by Clostridium acetobutylicum NRRL 527," *Curr. Microbiol.*, 13(4):215-219 (1986).
Jiang et al., "De novo computational design of retro-aldol enzymes," *Science*, 319(5868):1387-1391 (2008).
Johnson et al., "Alteration of a single amino acid changes the substrate specificity of dihydroflavonol 4-reductase," *Plant J.*, 25(3):325-333 (2001).
Jones et al., "Construction and characterization of F plasmid-based expression vectors," *Biotechnol. Bioengineer.*, 59:659-665 (1998).
Kakimoto et al., "β-Aminoisobutyrate-a-ketoglutarate transaminase in relation to β-aminoisobutyric aciduria," *Biochim. Biophys. Acta.*, 156(2):374-380 (1968).
Karlen et al., "Absolute determination of the activity of two C14 dating standards," *Arkiv Geofysik*, 4:465-471 (1968).
Kato et al., "3-Methylaspartate ammonia-lyase as a marker enzyme of the mesaconate pathway for (S)-glutamate fermentation in Enterobacteriaceae," *Arch. Microbiol.*, 168(6):457-463 (1997).
Kawasaki et al., "Transcriptional gene silencing by short interfering RNAs," *Curr. Opin. Mol. Ther.*, 7(2):125-131 (2005).
Kazahaya et al., "Aerobic Dissimilation of Glucose by Heterolactic Bacteria," *J. Gen. Appl. Microbiol.*, 18(1):43-55 (1972).
Keng et al., "Specificity of Aspartokinase III from Escherichia coli and an Examination of Important Catalytic Residues," *Arch. Biochem. Biophys.*, 335:73-81 (1996).

Kessler et al., "Pyruvate-formate-lyase-deactivase and acetyl-CoA reductase activities of *Escherichia coli* reside on a polymeric protein particle encoded by adhE," *FEBS. Lett.*, 281:59-63 (1991).
Khan et al., "Molecular properties and enhancement of thermostability by random mutagenesis of glutamate ehydrogenase from Bacillus subtilis," *Biosci. Biotechnol. Biochem.*, 69(10):1861-1870 (2005).
Killenberg-Jabs et al., "Active oligomeric states of pyruvate decarboxylase and their functional characterization," *Eur. J. Biochem.*, 268:1698-1704 (2001).
Kim et al., "Construction of an Escherichia coli K-12 Mutant for Homoethanologenic Fermentation of glucose or Xylose without Foreign Genes," *Appl. Environ. Microbiol.*, 73:1766-1771 (2007).
Kim et al., "Dihydrolipoamide Dehydrogenase Mutation Alters the NADH Sensitivity of Pyruvate Dehydrogenase Complex of *Escherichi coli* K-12," *J. Bacteriol.*, 190:3851-3858 (2008).
Kim, "Purification and Propertis of a mine α-Ketoglutarate Transaminase from *Escherichia coli*," *J. Biol. Chem.*, 239:783-786 (1964).
Kino et al., "Synthesis of DL-tryptophan by modified broad specificity amino acid racemase from Pseudomonas putida IFO 12996," *Appl. Microbiol. Biotechnol.*, 73(6):1299-1305 (2007).
Klatt et al., "Comparative genomics provides evidence for the 3-hydroxypropionate autotrophic pathway in filamentous anoxygenic phototrophic bacteria and in hot spring microbial mats," *Environ. Microbiol.*, 9(8):2067-2078 (2007).
Knapp et al., "Crystal Structure of the Truncated Cubic Core Component of the *Escherichia coli* 2-Oxoglutarate Dehydrogenase Multienzyme Complex," *J. Mol. Biol.*, 289:655-668 (1998).
Kobayashi et al., "Physiochemical, Catalytic, and Immunochemical Properties of Fumarases Crystallized Separately from Mitochondrial and Cytosolic Fractions of Rat Liver," *J. Biochem.*, 89:1923-1931 (1981).
Koo et al., "Cloning and characterization of the bifunctional alcohol/acetaldehyde dehydrogenase gene (adhE) in Leuconostoc mesenteroides isolated from kimchi," *Biotechnol. Lett.*, 27(7):505-510 (2005).
Korbert et al., "Crystallization of the NADP+-dependent Glutamate Dehydrogenase from *Escherichia coli*," *J. Mol. Biol.*, 234:1270-1273 (1993).
Korolev et al., "Autotracing of *Escherichia coli* acetate CoA-transferase α-subunit structure using 3.4 Å MAD and 1.9 Å native data," *Acta. Cryst. D.*, 58:2116-2121 (2002).
Kort et al., "Glutamate dehydrogenase from the hyperthermophilic bacterium Thermotoga maritima: molecular characterization and phylogenetic implications," *Extremophiles*, 1:52-60 (1997).
Kreimeyer et al., "Indentification of the Last Unknown Genes in the fermentation Pathway of Lysine," *J. Biol. Chem.*, 282:7191-7197 (2007).
Kretz et al., "Gene site saturation mutagenesis: a comprehensive mutagenesis approach," *Methods Enzymol.*, 388:3-11 (2004).
Krieger et al., "Pyruvate decarboxylase from Kluyveromyces lactis An enzyme with an extraordinary substrate activation behaviour," *Eur. J. Biochem.*, 269:3256-3263 (2002).
Kumamaru et al., "Enhanced degradation of polychlorinated biphenyls by directed evolution of biphenyl dioxgenase," *Nat. Biotechnol.*, 16(7)663-666 (1998).
Kurdistani et al., "Histone Acetylation and Deacetylation in Yeast," *Nat. Rev. Mol. Cell Biol.*, 4(4):276-284 (2003).
Kurihara et al., "A Novel Putrescine Utilization Pathway Involves γ-Glutamylated Intermediates of *Escherichia coli* K-12," *J. Biol. Chem.*, 280(6) 4602-4608 (2005).
Kuznetsova et al., "Enzyme genomics: Application of general enzymatic screens to discover new enzymes," *FEMS Microbiol. Rev.*, 29:263-279 (2005).
Kwok et al. "GFP-labelled Rubisco and aspartate aminotransferase are present in plastid stromules and traffic between plastids," *J. Exp. Bot.*, 55:(397)595-604 (2004).
Lam et al., "Metabolic Relationships between Pyridoxine (vitamin B6) and Serine Biosynthesis in *Escherichia coli* K-12," *J. Bacteriol.*, 172(11):6518-6528 (1990).
Lamas-Maceiras et al., "Amplification and disruption of the phenylacetyl-CoA ligase gene of Penicillium chrysogenum encoding an aryl-capping enzyme that supplies phenylacetic acid to the isopenicillin N-acyltransferase," *Biochem. J.*, 395:147-155 (2006).

(56) References Cited

OTHER PUBLICATIONS

Lamed et al., "Novel NAP-linked alcohol-aldehyde/ketone oxidoreductase in thermophilic ethanologenic bacteria," *Biochem. J.*, 195:183-190 (1981).
Lebbink et al., "Engineering activity and stability of Thermotoga maritima Glutamate Dydrogenase. I. Introduction of a Six-residue Ion-pair Network in the Hinge Region," *J. Mol. Biol.*, 280:287-296 (1998).
Lebbink et al., "Engineering activity and stability of Thermotoga maritima glutamate dehydrogenase. II: construction of a 16-residue ion-pair network at the subunit interface," *J. Mol. Biol.*, 289(2):357-369 (1999).
Leduc et al., "The Hotdog Thiesterase EntH (YbdB) Plays a Role in Vivo in Optimal Enterobactin biosynthesis by Interacting with the ArCP Domain of EntB," *J. Bacteriol.*, 189(19):7112-7126 (2007).
Lee et al., "Identification of essential active-site residues in ornithine decarboxylase of Nicotiana glutinosa decarboxylating both L-ornithine and L-lysine," *Biochem. J.*, 360(Pt 3):657-665 (2001).
Lee et al., "Phylogenetic diversity and the structural basis of substrate specificity in the beta/alpha-barrel fold basic amino acid decarboxylases," *J. Biol. Chem.*, 282(37):27115-27125 (2007).
Lee et al., "A new approach to directed gene evolution by recombined extension on truncated templates (RETT)," *J. Molec. Catalysis*, 26:119-129 (2003).
Lee et al., "Antisense technology in molecular and cellular bioengineering," *Curr. Opin. Biotechnol.*, 14(5):505-511 (2003).
Lemonnier et al., "Expression of the second lysine decarboxylase gene of *Escherichia coli*," *Microbiology*, 144(Pt 3):751-760 (1998).
Lenski et al., "Dynamics of adaptation and diversification: A 10,000-generation experiment with bacterial poulations," *Proc. Natl. Acad. Sci. USA*, 91:6808-6814 (1994).
Lepore et al., "The x-ray crystal structure of lysine-2,3-aminomutase from Clostridium subterminale," *Proc. Natl. Acad. Sci. U.S.A.*, 102:13819-13824 (2005).
Li et al., "Effects of Substitution of Tryptophan 412 in the Substrate Activation Pathway of Yeast Pyruvate Decarboxylase," *Biochemistry*, 38:10004-10012 (1999).
Li et al., "Harnessing homologous recombination in vitro to generate recombinant DNA via SLIC," *Nature Methods*, 4(3):251-256 (2007).
Lian et al., "Sterochemical and Isotopic Labeling Studies of 4-Oxalocrotonate Decarboxylase and Vinylpyruvate Hydratase: Analysis and Mechanistic Implications," *J. Am. Chem. Soc.*, 116:10403-10411 (1994).
Lin et al., "Fed-batch culture of a metabolically engineered *Escherichia coli* strain designed for high-level succinate production and yield under aerobic conditions," *Biotechnol. Bioeng.*, 90(6):775-779 (2005).
Lin et al., "Functional expression of horseradish peroxidase in *E. coli* by directed evolution," *Biotechnol. Prog.*, 15(3):467-471 (1999).
Lingen et al., "Alteration of the Substrate Specificity of Benzoylformate Decarboxylase from Pseudomonas putida by Directed Evolution," *Chembiochem.*, 4:721-726 (2003).
Lingen et al., "Improving the carboligase activity of benzoylformate decarboxylase from Pseudomonas putida by a combination of directed evolution and site-directed mutagenesis," *Protein Eng.*, 15:585-593 (2002).
Liu et al., "Crystal Structures of Unbound and Aminoxyacetate-Bound Escericiha coli Y-Aminobutyrate Aminotransferase," *Biochemistry*, 43:10896-10905 (2004).
Liu et al., "Kinetic and crystallographic analysis of active site mutants of *Escherichia coli* gamma-aminobutyrate aminotransferase," *Biochemistry*, 44:(8):2982-2992 (2005).
Lokanath et al., "Crystal Structure of novel NADP-dependent 3-Hydroxyisobutyrate Dehydrogenase from Thermus thermophilus HB8," *J. Mol Biol.*, 352:905-917 (2005).
Louie et al., "Cloning and characterization of the gamma-glutamyl phosphate reductase gene of Campylobacter jejuni," *Mol. Gen. Genet.*, 240:29-35 (1993).

Louis et al., "Restricted Distribution of the Butyrate Kinase Pathway among Butyrate-Producing Bacteria from the Human Colon," *J. Bacteriol.*, 186(7):2099-2106 (2004).
Low et al., "Mimicking somatic hypermutation: affinity maturation of antibodies displayed on baceriophage using a bacterial mutator strain," *J. Mol. Biol.*, 260(3):359-368 (1996).
Lu et al., "Functional analysis and regulation of the divergent spuABCDEFG-spuI operons for polyamine uptake and utilization in Pseudomonas aeruginosa PA01," *J. Bacteriol.*, 184:3765-3773 (2002).
Lutke-Eversloh et al., "Biochemical and molecular characterization of a succinate semialdehyde dehydrogenase involved in the catabolism of 4-hydroxybutyric acid in Ralstonia eutropha," *FEMS Microbiol. Lett.*, 181:63-71 (1999).
Lutz et al., "Creating multiple-crossover DNA libraries independent of sequence identity," *Proc. Natl. Acad. Sci. U.S.A.*, 98(20):11248-11253 (2001).
Lutz et al., "Independent and tight regulation of transcriptional units in *Escherichia coli* via the LacR/O, the TetR/O and AraC/11-12 regulatory elements," *Nucleic Acids Res.*, 25:1203-1210 (1997).
Lutz et al., "Rapid generation of incremental truncation libraries for protein engineering using α-phosphothioate nucleotides," *Nucleic Acids Res.*, 15:29(4):e16 (2001).
Ma et al., "Induced Rebuilding of Aspartase Confromation," *Ann. N.Y. Acad. Sci.*, 672:60-65 (1992).
Mack et al., "Location of the two genes encoding glutaconate coenzyme A-transferase at the beginning of the hydroxyglutarate operon in Acidaminococcus fermentans," *Eur. J. Biochem.*, 226:41-51 (1994).
Mack et al., "Conversion of glutaconate CoA-transferase from Acidaminococcus fermentas into an acyl-CoA hydrolase by site-directed mutagenesis," *FEBS Lett.*, 405:209-212 (1997).
Mahan et al., "Genetic analysis of the proBA genes of Salmonella typhimurium: physical and genetic analyses of the cloned proB+ A+ genes of *Escherichia coli* and of a mutant allele that confers proline overproduction and enhanced osmotolerance," *J. Bacteriol.*, 156(3):1249-1262 (1983).
Mann et al., "Proteomic analysis of post-translational modifications," *Nature Biotech.*, 21:255-261 (2003).
Mann, "An International Reference Material for Radiocarbon Dating" *Radiocarbn*, 25(2):519-527 (1983).
Manning et al., "Tracer studies of the interconversion of R- and S-methylmalonic semialdehydes in man," *Biochem. J.*, 231:481-484 (1985).
Marco-Marin et al., "Site-directed Mutagenesis of *Escherichia coli* Acetylglutamate Kinase and Aspartokinase III Probes the Catalytic and Substrate-binding Mechanisms of these Amino Acid Kinase Family Enzymes and Allows Three-dimensional Modelling of Aspartokinase," *J. Mol. Biol.*, 334:459-476 (2003).
Marek et al., "Cloning and expression of the *Escherichia coli* K-12 sad gene," *J. Bacteriol.*, 170(2):991-994 (1988).
Marks et al., "Molecular Cloning and Characterization of (R)-3-Hydroxybutyrate Dehydrogenase from Human Heart," *J. Biol. Chem.*, 267:15459-15463 (1992).
Martinez-Blanco et al., "Purification and Biochemical Characterization of Phenylacetyl-CoA Ligase from Pseudomonas putida," *J. Biol. Chem.*, 265(12):7084-7090 (1990).
Mattevi, "Atomic structure of the cubic core of the pyruvate dehydrogenase multienzyme complex," *Science*, 255:1544-1550 (1992).
Matthies et al., "Reciprocal Isomerization of Butyrate and Isobutyrate by the Strictly Anaerobic Bacterium Strain WoG13 and Methanogenic Isobutyrate Degradation by a Devined Triculture," *Appl. Environ. Microbiol.*, 58(5):1435-1439 (1992).
McCue et al., "Gene Expression and Stress Response Mediated by the Epigenetic Regulation of a Transposable Element Small Rna," *PLoS Genet.*, 8(2):e1002474 (2012).
McPherson et al., "Complete nucleotide sequence of the *Escherichia coli* gdhA gene," *Nucleic Acids Res.*, 11(15):5257-5266 (1983).
Meng et al., "Site-Directed Mutagenesis and functional Analysis of the Active-Site Residues of the E2 Component of Bovine Branched-Chain α-Keto Acid Dehydrogenase Complex," *Biochemistry*, 33:12879-12885 (1994).

(56) References Cited

OTHER PUBLICATIONS

Menzel et al., "Enzymatic evidence for an involvement of pyruvate dehydrogenase in the anaerobic glycerol metabolism of Klebsiella pneumoniae," *J. Biotechnol.*, 56:135-142 (1997).
Menzel et al., "Kinetic, dynamic, and pathway studies of glycerol metabolism by Klebsiella pneumoniae in anaerobic continuous culsutre: IV. Enzynmes and fluxes of pyruvate metabolism," *Biotechnol. Bioeng.*, 60(5):617-626 (1998).
Metz et al., "Purification of a jojoba embryo fatty acyl-coenzyme A reductase and expression of its cDNA in high erucic acid rapeseed," *Plant Physiol.*, 122(3):635-644 (2000).
Miko, "Phenotype Variability: Penetrance and Expressivity," *Nature Education*, 1:137 (2008).
Minohara et al., "Improved H+/O ratio and cell yield of *Escherichia coli* with genetically altered terminal quinol oxidases," *J. Biosci. Bioeng.*, 93(5):464-469 (2002).
Misono et al., "Occurrence of L-Lysine ε-Dehydrogenase in Agrobacterium tumefaciens," J. Bacteriol., 150(1):398-401 (1982).
Miyazaki et al., "α-Aminoadipate aminotransferase from an extremely thermophilic bacterium, Thermus thermophilus," *Microbiology*, 150:2327-2334 (2004).
Mizobata et al., "Purification and Characterization of a thermostable Class II Fumarase from Thermus thermophilus," *Arch. Biochem. Biophys.*, 355:49-55 (1998).
Momany et al., "Crystallographic Structures of a PLP-Dependent Ornithine Decarboxylase from Lactobacillus 30a to 3.0 Å Resolution," *J. Mol. Biol.*, 242:643-655 (1995).
Monnet et al., " Regulation of branched-chain amino acid biosynthesis by alpha-acetolactate decarboxylase in *Streptococcus thermophilus,"* Lett. Appl. Microbiol.*, 36:399-405 (2003).
Moore et al., "Expression and Purification of Aspartate β-Semialdehyde Dehydrogenase from Infectious Microorganisms," *Protein Expr. Purif.*, 25:189-194 (2002).
Morris et al., "Nucleotide sequence of the LYS2 gene of *Saccharomyces cerevisiae*: homology to Bacillus brevis tyrocidine synthetase 1," *Gene*, 98:141-145 (1991).
Muller et al., "Nucleotide exchange and excision technology (Next) DNA shuffling: a robust method for DNA fragmentation and directed evolution," *Nucleic Acids Res.*, 33:e117 (2005).
Musfeldt et al., "Novel Type of ADP-Forming Acetyl Coenzyme A Synthetase in Hyperthermophilic Archaea: Heterologous Expression and Characterization of Isoenzymes from the Sulfate Reducer Archaeoglobus fulgidus and the Methanogen Methanococcus jannaschii," *J. Bacteriol.*, 184(3):636-644 (2002).
Naggert et al., " Cloning, sequencing, and characterization of *Escherichia coli* thioesterase II," *J. Biol. Chem.*, 266(17):11044-11050 (1991).
Najmudin et al., "Purification, crystallization and preliminary X-ray crystallographic studies on acetolactate decarboxylase," *Acta. Crystallogr. D. Biol. Crystallog.*, 59:1073-1075 (2003).
Nakahigashi et al., "Nucleotide sequence of the fadA and fadB genes from *Escherichia coli,"* Nucleic Acids Res.*, 18(16):4937 (1990).
Nakai et al., "A knowledge base for predicting protein localization sites in eukaryotic cells," *Genomics*, 14(4):897-911 (1992).
Nakano et al., "Characterization of Anaerobic Fermentative Growth of Bacillus subtilis: Identification of Fermentation End Products and Genes Required for Growth," *J. Bacteriol.*, 179(21):6749-6755 (1997).
Namba et al., "Coenzyme A and Nicotinamide Adenine dinucleotide-deptendent Branched Chain α-Keto Acid Dehydrogenase," *J. Biol. Chem.*, 244:4437-4447 (1969).
Nashizawa et al., "Regulation of inducible gene expression by natural antisense transcripts," *Front Biosci.*, 17:938-958 (2012).
Ness et al., "Synthetic shuffling expands functional protein diversity by allowing amino acids to recombine independently," *Nat. Biotechnol.*, 20(12):1251-1255 (2002).

Niegemann et al., "Molecular organization of the *Escherichia coli* gab cluster: nucleotide sequence of the structural genes gabD and gabP and expression of the GABA permease gene," *Arch. Microbiol.*, 160:454-460 (1993).
Nishizawa et al., "Gene expression and characterization of two 2-oxoacid:ferredoxin oxidoreductases from Aeropyrum pernix K1," *FEBS. Lett.*, 579:2319-2322 (2005).
Niu et al., "Benzene-free synthesis of adipic acid," *Biotechnol. Prog.*, 18:201-211 (2002).
Noguchi et al., "The energetic conversion competence of *Escherichia coli* during aerobic respiration studied by 31P NMR using a circulating fermentation system," *J. Biochem.*, 136:509-515 (2004).
Nolling et al., "Genome sequence and comparative analysis of the solvent-producing bacterium Clostridium acetobutylicum," *J. Bacteriol.*, 183(16):4823-4838 (2001).
Nowicki et al., "Recombinant tyrosine aminotransferase from Trypanosoma cruzi: structural characterization and site directed mutagenesis of a broad substrate specificity enzyme," *Biochim. Biophys. Acta*, 1546(2):268-281 (2001).
O'Reilly et al., "Sequence and analysis of the citrulline biosynthetic operon argC-F from Bacillus subtilis," *Microbiology*, 140:1023-1025 (1994).
O'Sullivan, "Aptasensors—the future of biosensing?," *Anal. Bioanal. Chem.*, 372(1):44-48 (2002).
O'Sullivan, et al., "Purification and characterisation of acetolactate decarboxylase from Leuconostoc lactis NCW1," *FEMS Microbiol. Lett.*, 194(2):245-249 (2001).
Ohgami et al., "Expression of acetoacetyl-CoA synthetase, a novel cytosolic ketone body- utilizing enzyme, in human brain," *Biochem. Pharmacol.*, 65:989-994 (2003).
Oku et al., "Biosynthesis of Branched-chain Fatty Acids in Bacillis subtilis," *J. Biol. Chem.*, 263:18386-18396 (1988).
Okuno et al., "2-Aminoadipate-2-oxoglutarate aminotransferase isoenzymes in human liver: a plausible physiological role in lysine and tryptophan metabolism," *Enzyme Protein*, 47(3):136-148 (1993).
Olivera et al., "Molecular characterization of the phenylacetic acid catabolic pathway in Pseudomonas putida U: The phenylacetyl-CoA catabolon," *Proc. Natl. Acad. Sci. U.S.A.*, 95:6419-6424 (1998).
Onuffer et al., "Redesign of the substrate specificity of Escherichia coli aspartate aminotransferase to that of Escherichia coli tyrosine aminotransferase by homology modeling and site-directed mutagenesis," *Protein Sci.*, 4:1750-1757 (1995).
Orencio-Trejo et al., "Metabolic regluation analysis of an ethanologenic *Escherichia coli* strain based on RT-PCR and enzymatic activities," *Biotechnol. Biofuels*, 1:8 (2008).
Ostermeier et al., "A combinatorial approach to hybrid enzymes independent of DNA homology," *Nat. Biotechnol.*, 17(12):1205-1209 (1999).
Ostermeier et al., "Combinatorial protein engineering by incremental truncation," *Proc. Natl. Acad. Sci. U.S.A.*, 96(7):3562-3567 (1999).
Otten et al., "Directed evolution: selecting today's biocatalysts," *Biomol.Eng.*, 22:1-9 (2005).
Palosaari et al., "Purification and properties of the inducible coenzyme A-linked butyraldehyde dehydrogenase from Clostridium acetobutylicum," *J. Bacteriol.*, 170(7):2971-2976 (1988).
Park et al., "Biosynthesis of poly(3-hydroxybutyrate- co-3-hydroxyalkanoates) by metabolically engineered *Escherichia coli* strains," *Appl. Biochem. Biotechnol.*, 113-116:335-346 (2004).
Park et al., "Identification and Characterization of a New Enoyl coenzyme A Hydratase involved in biosynthesis of Medium-Chain-Length Polyhdroxyalkanoates in recombinant Escherichia coli," *J. Bacteriol.*, 185(18):5391-5397 (2003).
Park et al., "New FadB homologous enzymes and their use in enhanced biosynthesis of medium-chain-length polyhydroxyalkanoates in FadB mutant *Escherichia coli, " Biotechnol. Bioeng.*, 86:681-686 (2004).
Park et al., "Regulation of succinate dehydrogenase (sdhCDAB) operon expression ion Escherichia coli in response to carbon supply and anaerobiosis: role of ArcA and Fnr," *Mol. Microbiol.*, 15:473-482 (1995).
Parker et al.,"Characterization of the Zymomonas mobilis glucose facilitator gene product (glf) in recombinant *Escherichia coli*:

(56) References Cited

OTHER PUBLICATIONS examination of transport mechanism, kinetics and the role of glucokinase in glucose transport," *Mol Microbiol.*, 15(5):795-802 (1995).
Parsot et al., "Nucleotide sequence of *Escherichia coli* argB and argC genes: comparison of N-acetylglutamate kinase and N-acetylglutamate-gamma-semialdehyde dehydrogenase with homologous and analogous enzymes," *Gene*, 68(2): 275-283 (1988).
Pasquinelli, "MicroRNAs and their targets: recognition, regulation and an emerging reciprocal relationship," *Nat. Rev. Genet.*, 13(4):271-282 (2012).
Pauwels et al., "The N-acetylglutamate synthase? N-acetylglutamate kinase metabolon of *Saccharomyces cerevisiae* allows cor-ordinated feedback regulation of the first two steps in arginine biosynthesis," *Eur. J. Biochem.*, 270:1014-1024 (2003).
Paxton et al., "Role of branched-chain 2-oxo acid dehydrogenase and pyruvate dehydrogenase in 2-oxobutyrate metabolism," *Biochem. J.*, 234:295-303 (1986).
Peretz et al., "Amino Acid Sequence of Alcohol Dehydrogenase from the Thermophilic Bacterium Thermoanaerobium brockii," *Biochemistry*, 28:6549-6555 (1989).
Petitdemange et al., "Regulation of the NADH and NADPH-ferredoxin oxidoreductases in clostridia of the butyric group," *Biochim. Biophys. Acta.*, 421(2):334-337 (1976).
Phalip et al., "Purification and properties of the alpha-acetolactate decarboxylase from *Lactococcus lactis* subsp. Lactis NCDO 2118," *FEBS Lett.*, 351:95-99 (1994).
Pohl et al., "Remarkably broad substrate tolerance of malonyl-CoA synthetase, an enzyme capable of intracellular synthesis of polyketide precursors," *J. Am. Chem Soc.*, 123(24):5822-5823 (2001).
Pohlmann et al., "Genome sequence of the bioplastic-producing "Knallgas" bacterium Ralstonia eutropha H16," *Nat. Biotechnol.*, 24(10):1257-1262 (2006).
Polovnikova et al., "Structural and Kinetic Analysis of Catalysis by a thiamin diphosphate-Dependent Enzyme, Benzoylformate Decarboxylase," *Biochemistry*, 42:1820-1830 (2003).
Poston, "Assay of leucine 2,3-aminomutase," *Methods Enzymol.*, 166:130-135 (1988).
Powlowski et al., "Purification and properties of the physically associated meta-cleavage pathway enzymes 4-hydroxy-2-ketovalerate aldolase and aldehyde dehydrogenase (acylating) from *Pseudomonas* sp. strain CF600," *J. Bacteriol.*, 175:377-385 (1993).
Pritchard et al., "A general model of error-prone PCR," *J. Theor. Biol.*, 234:497-509 (2005).
Purnell et al., "Modulation of higher-plant NAD(H)-dependent glutamate dehydrogenase activity in transgenic tobacco via alteration of beta subunit levels," *Planta*, 222:167-180 (2005).
Qi et al., "Functional expression of prokaryotic and eukaryotic genes in *Escherichia coli* for conversion of glucose to p-hydroxystyrene," *Metab. Eng.*, 9:268-276 (2007).
Rajpal et al., "A general method for greatly improving the affinity of antibodies by using combinatorial libraries," *Proc. Natl. Acad. Sci. U.S.A.*, 102(24):8466-8471 (2005).
Ramon-Maiques et al., "Structure of Acetylglutamate Kinase, a Key Enzyme for Arginine Biosynthesis and a Prototype for the Amino Acid Kinase Enzyme Family, during Catalysis," *Structure*, 10:329-342 (2002).
Ramos et al., "Mutations affecting the enzymes involved in the utilization of 4-aminobutyric acid as nitrogen source by the yeast *Saccharomyces cerevisiae*," *Eur. J. Biochem.*, 149:401-404 (1985).
Rathinasabapathi, "Propionate, a source of β-alanine, is an inhibitor of β-alanine methylation in Limonium latifolium, Plumbaginaceae," *J. Plant Physiol.*, 159:671-674 (2002).
Recasens et al., "Cysteine Sulfinate Aminotransferase and Aspartate Aminotransferase Isoenzymes of Rat Brain. Purification, Characterization, and Further Evidence for Identity," *Biochemistry*, 19:4583-4589 (1980).
Reetz et al., "Creation of Enantioselective biocatalysts for Organic Chemistry by In Vitro Evolution," *Agnew. Chem. Int. Ed. Engl.*, 36:2830-2832 (1997).
Reetz et al., "Directed Evolution of an Enantioselective Enzyme through Combinatorial Multiple-Cassette Mutagenesis," *Agnew. Chem. Int. Ed. Engl.*, 40:3589-3591 (2001).
Reetz et al., "Iterative saturation mutagenesis (ISM) for rapid directed evolution of functional enzymes," *Nat. Protoc.*, 2(4):891-903 (2007).
Reetz et al., "Iterative Saturation Mutagenesis on the Basis of B Factors as a Strategy for Increasing Protein Thermostability," *Agnew. Chem. Int. Ed. Engl.*, 45:7745-7751 (2006).
Reetz et al., "Expanding the range of substrate acceptance of enzymes: combinatorial active-site saturation test," *Agnew. Chem. Int. Ed Engl.*, 44:4192-4196 (2005).
Reidhaar-Olson et al., "Combinatorial cassette mutagenesis as a probe of the informational content of protein sequences," *Science*, 241(4861):53-57 (1988).
Reidhaar-Olson et al., "Random mutagenesis of protein sequences using oligonucleotide cassettes," *Methods Enzymol.*, 208:564-586 (1991).
Reiser te al., "Isolation of mutants of Acinetobacter calcoaceticus deficient in wax ester synthesis and complementation of one mutation with a gene encoding a fatty acyl coenzyme A reductase," *J. Bacteriol.*, 179(9):2969-2975 (1997).
Repetto et al., "Structure and Regulation of KGD1, the Structural Gene for Yeast α-Ketoglutarate Dehydrogenase," *Mol. Cell.*, 9:2695-2705 (1989).
Resnekov et al., "Organization and regulation of the Bacillus subtilis odhAB operon, which encodes two of the subenzymes of the 2-oxoglutarate dehydrogenase complex," *Mol. Gen. Genet.*, 234(2):285-296 (1992).
Rigden et al., "A cofactor-dependent phosphoglycerate mutase homolog from Bacillus stearothermophilus is actually a broad specificity phosphatase," *Protein Sci.*, 10:1835-1846 (2001).
Ringner et al., "Folding free energies of 5'-UTRs impact post-transcriptional regulation on a genomic scale in yeast," *PLoS Comput. Biol.*, 1(7):e72 (2005).
Riviere et al., "Acetyl:Succinate CoA-transferase in Procyclic Trypanosoma brucei," *J. Biol. Chem.*, 279(44):45337-45346 (2004).
Robinson et al., "Studies on Rat Brain Acyl-Coenzyme a Hydrolase (Short Chain)," *Biochem. Biophys. Res. Commun.*, 71:959-965 (1976).
Roca et al., "Metabolic engineering of ammonium assimilation in xylose-fermenting Saccharmyces cerevisiae improves ethanol production," *Appl. Environ. Microbiol.*, 69(8):4732-4736 (2003).
Rodriguez et al., "Characterization of the p-coumaric acid decarboxylase from Lactobacillus plantarum CECT 748(T)," *J. Agric. Food Chem.*, 56(9):3068-3072 (2008).
Rohdich et al., "Enoate reductases of Clostridia. Cloning, sequencing, and expression," *J. Biol. Chem.*, 276(8):5779-5787 (2001).
Romero et al., "Partial purification, characterization and nitrogen regulation of the lysine epsilon-aminotransferase of Streptomyces clavuligerus," *J. Ind. Microbiol. Biotechnol.*, 18(4):241-246 (1997).
Rose et al., "The role of the allosteric B site in the fumarase reaction," *Proc. Natl. Acad. Sci. U.S.A.*, 101:3393-3397 (2004).
Rose et al., "Enzymatic phosphorylation of acetate," *J. Biol. Chem.*, 211(2):737-756 (1954).
Roy et al., "Cloning and Characterization of the Gene Encoding Lipamide Dehydrogenase in *Saccharomyces cerevisiae*," *J. Gen. Microbiol.*, 133:925-933 (1987).
Ruldeekulthamrong et al., "Molecular characterization of lysine 6-dehydrogenase from Achromobacter denitrificans," *BMB Rep.*, 41:790-795 (2008).
Russell et al., "Peptide Signals Encode Protein Localization," *J. Bacteriol.*, 189(21):7581-7585 (2007).
Sabo et al., "Purification and Physical Properties of Inducible Escherichia coli Lysine Decarboxylase," *Biochemistry*, 13(4):662-670 (1974).
Saito et al., "Microbial synthesis and properties of poly(3-hydroxybutyrate-co-4-hydroxybutyrate) in Comamonas acidovorans," *Int. J. Biol. Macromol.*, 16:99-104 (1994).
Samsonova et al., "Molecular cloning and characterization of Escherichia coli K12 ygjG gene," *BMC Microbiol.*, 3:2 (2003).

(56) References Cited

OTHER PUBLICATIONS

Sariaslani, "Development of a combined biological and chemical process for production of industrial aromatics from renewable resources," *Annu. Rev. Microbiol.*, 61:51-69 (2007).
Sarovich et al., "pPSX: a novel vector for the cloning and heterologous expression of antitumor antibiotic gene clusters," *Plasmid*, 57:306-313 (2007).
Sato et al., "Poly[(R)-3-Hydroxybutyrate] Formation in Escherichia coli from Glucose through an Enoyl-CoA Hydratase-Mediated Pathway," *J. Biosci. Bioeng.*, 103(1):38-44 (2007).
Scherf et al., "Purification and properties of 4-hydroxybutyrate coenzyme A transferase from Clostridium aminobutyricum," *Appl. Environ. Microbiol.*, 57(9):2699-2702 (1991).
Scherf et al., "Purification and properties of an iron-sulfur and FAD-containing 4-hydroxybuturyl-CoA dehydratase/vinylacetyl-CoA Δ3 —Δ2-isomerase from Clostridium aminobutyricum," *Eur. J. Biochem.*, 215:421-429 (1993).
Scherf et al., "Suffinate-ethanol fermentation in Clostridium kluyveri: purification and characterisation of 4-hydroxybutyryl-CoA dehydratase/vinylacetyl-CoA delta 3-delta 2-isomerase," *Arch. Microbiol.*, 161:239-245 (1994).
Schneider et al., "The Escherichia coli gabDTPC operon: specific γ-aminobutyrate catabolism and nonspecific induction," *J. Bacteriol.*, 184:6976-6986 (2002).
Schulz et al., "Stereopsecific Production of the Herbicide Phosphinothricin (Glufosinate) by Transamination: Isolation and Characterization of a Phosphinothricin-Specific Transaminase from *Escherichia coli*," *Appl. Environ. Microbiol.*, 56:1-6 (1990).
Scott et al., "Soluble γ-Aminobutyric-Glutamic Transaminase from Pseudomonas fluorescens," *J. Biol. Chem.*, 234:932-936 (1959).
Seedorf et al., "The genome of Clostridium kluyveri, a strict anaerobe with unique metabolic features," *Proc. Natl. Acad. Sci. U.S.A.*, 105(6):2128-2133 (2008).
Selifonova et al., "Rapid evolution of novel traits in microorganisms," *Appl. Environ. Microbiol.*, 67(8):3645-3649 (2001).
Sen et al., "Developments in directed evolution for improving enzyme functions," *Appl. Biochem. Biotechnol.*, 143(3):212-223 (2007).
Shafiani et al., "Cloning and characterization of aspartate-β-semialdehyde dehydrogenase from *Mycobacterium tuberculosis* H37 Rv," *J. Appl. Microbiol.*, 98:832-838 (2005).
Shames et al., "Interaction of aspartate and aspartate-derived antimetabolites with the enzymes of the threonine biosynthetic pathway of *Escherichia ecoli*," *J. Biol. Chem.*, 259(24):15331-15339 (1984).
Shao et al., "Random-priming in vitro recombination: an effective tool for directed evolution," *Nucleic Acids Res.*, 26(2):681-683 (1998).
Shi et al., "The structure of L-aspartate ammonia-lyase from *Escherichia coli*," *Biochem.*, 36(30):9136-9144 (1997).
Shigeoka et al., "Characterization and molecular properties of 2-oxoglutarate decarboxylase from Euglena gracilis," *Arch. Biochem. Biophys.*, 288:22-28 (1991).
Shigeoka et al., "Effect of L-glutamate on 2-oxoglutarate decarboxylase in Euglena gracilis," *Biochem. J.*, 282 ( Pt 2):319-323 (1992).
Shigeoka et al., "The effect of thiamin on the activation of thiamin pyrophosphate-dependent 2-oxoglutarate decarboxylase in Euglena gracilis," *Biochem. J.*, 292 (Pt 2):463-467 (1993).
Shimomura et al., "3-Hydroxyisobutyryl-CoA Hydrolase," *Meth. Enzymol.*, 324:229-240 (2000).
Shimomura et al., "Purification and Partial Characterization of 3-Hydroxyisobutyryl-coenzyme A Hydrolase of Rat Liver," *J. Biol. Chem.*, 269:14248-14253 (1994).
Shingler et al., "Nucleotide Sequence and Functional Analysis of the Complete Phenol/3,4-Dimethylphenol Catabolic Pathway of *Pseudomonas* sp. Strain CF600," *J. Bacteriol.*, 174(3):711-724 (1992).
Shukla et al., "Production of D(-)-lactate from sucrose and molasses," *Biotechnol. Lett.*, 26(9):689-693 (2004).
Sieber et al., "Libraries of hybrid proteins from distantly related sequences," *Nat. Biotechnol.*, 19(5):456-460 (2001).
Siegert et al., "Exchanging the substrate specificities of pyruvate decarboxylase from Zymomonas mobilis and benzoylase from Pseudomonas putida," *Protein Eng. Des. Sel.*, 18:345-357 (2005).
Silverman et al., "Arc and Sfr functions of the *Escherichia coli* K-12 arcA gene product are genetically and physiologically separable," *J. Bacteriol.*, 173(18):5648-5652 (1991).
Simicevic et al., "DNA-centered approaches to characterize regulatory protein-DNA interaction complexes," *Mol. Biosyst.*, 6(3):462-468 (2010).
Simonov et al., "Application of Gas Chromatography and Gas Chromatography-Mass Spectrometry to the Detection of γ-Hydroxybutyric Acid and Its Precursors in Various Materials," *J. Anal. Chem.*, 59:965-971 (2004).
Sinclair et al., "Purification and characterization of the branched chain α-ketoacid dehydrogenase complex from *Saccharomyces cerevisiae*," *Biochem. Mol. Biol. Int.*, 31(5):911-922 (1993).
Sivaraman et al., "Codon choice in genes depends on flanking sequence information—implications for theoretical reverse translation," *Nucleic Acids Res.*, 36(3):e16 (2008).
Sjostrom et al., "Purfication and characterisation of a plasminogen-binding protein from Haemophilus influenzae. Sequence determination reveals identity with aspartase," *Biochim. Biophys. Acta.*, 1324:182-190 (1997).
Skarstedt et al., "*Escherichia coli* Acetate Kinase Mechanism Studied by Net Initial Rate, Equilibriu, and Independent Isotopic Exchange Kinetics," *J. Biol. Chem.*, 251:6775-6783 (1976).
Smit et al., "Identification, Cloning, and Characterization of a Lactococcus lactis Branched-Chain α-Keto Acid Decarboxylase Involved in Flavor Formation," *Appl. Environ. Microbiol.*, 71:303-311 (2005).
Smith et al., "Fumarate metabolism and the microaerophily of Campylobacter species," *Int. J. Biochem. Cell Biol.*, 31:961-975 (1999).
Smith et al., "Purification and characteristics of a gamma-glutamyl kinase involved in *Escherichia coli* proline biosynthesis," *J. Bacteriol.*, 157:545-551 (1984).
Soda et al., "L-Lysine: alpha-ketoglutarate aminotransferase. II. Purification, crystallization, and properties," *Biochemistry*, 7(11):4110-4119 (1968).
Sohling et al., "Molecular analysis of the anaerobic succinate degradation pathway in Clostridium kluyveri.," *J. Bacteriol.*, 178(3):871-880 (1996).
Sohling et al., "Purification and characterization of a Coenzyme-A-dependent succinate-semialdehyde dehydrogenase from Clostridium kluyveri," *Eur. J. Biochem.*, 212:121-127 (1993).
Sokatch et al., "Purification of a Branched-Chain Keto Acid Dehydrogenase from Pseudomonas putida," *J. Bacteriol.*, 647-652 (1981).
Song et al., "Construction of recombinant *Escherichia coli* strains producing poly (4-hydroxybutyric acid) homopolyester from glucose," *Wei Sheng Wu Xue.Bao.*, 45:382-386 (2005). (English abstract attached).
Song et al., "Structure, Function, and Mechanism of the Phenylacetate Pathway Hot Dog-fold Thioesterase PaaI," *J. Biol. Chem.*, 281(16):11028-11038 (2006).
Stadtman, "The enzymatic synthesis of β-alanyl coenzyme A," *J. Am. Chem. Soc.*, 77:5765-5766 (1955).
Stanley et al., "Expression and stereochemical and isotope effect studies of active 4-oxalocrotonate decarboxylase," *Biochemistry* 39(12):3514 (2000).
Steinbüchel et al., "NAD-linked L(+)-lactate dehydrogenase from the strict aerobe alcaligenes eutrophus. 2. Kinetic properties and inhibition by oxaloacetate," *Eur. J. Biochem.*, 130(2):329-334 (1983).
Stemmer, "DNA Shuffling by random fragmentation and reassembly: in vitro recombination for molecular evolution," *Proc. Natl. Acad. Sci. U.S.A.*, 91(22):10747-10751 (1994).
Stemmer, "Rapid evolution of a protein in vitro by DNA shuffling," *Nature*, 370:389-391 (1994).
Stoyan et al., "Cloning, sequencing and overexpression of the leucine dehydrogenase gene from Bacillus cereus," *J. Biotechnol.*, 54:77-80 (1997).

(56) References Cited

OTHER PUBLICATIONS

Strauss et al., "Enzymes of a novel autotrophic CO2 fixation pathway in the phototrophic bacterium Chloroflexus aurantiacus, the 3-hydroxypropionate cycle," *Eur. J. Biochem.*, 215:633-643 (1993).
Suda et al., "Purification and properties of alpha-keoadipate reductase, a newly discovered enzyme from human placenta," *Arch. Biochem. Biophys.*, 176(2):610-620 (1976).
Suda et al., "Subcellular Localization and tissue Distribution of α-Ketodaipate Reduction and Oxidation in the Rat," *Biochem. Biophys. Res. Commun.*, 77:586-591 (1977).
Sulzenbacher et al., "Crystal structure of *E.coli* alcohol dehydrogenase YqhD: evidence of a covalently modified NADP coenzyme," *J. Mol. Biol.*, 342(2):489-502 (2004).
Sunohara et al., "Nascent-peptide-mediated ribosome stalling at a stop codon induces mRNA cleavage resulting in nonstop mRNA that is recognized by tmRNA," *RNA*, 10(3):378-386 (2004).
Sunohara et al., "Ribosome stalling during translation elongation induces cleavage of mRNA being translated in *Escherichia coli*," *J. Biol. Chem.*, 279:15368-15375 (2004).
Suthers et al., "Metabolic flux elucidation for large-scale models using 13C labeled isotopes," *Metab. Eng.*, 9(5-6):387-405 (2007).
Suzuki et al., "GriC and GriD Constitute a carboxylic acid reductase involved in grixazone biosynthesis in Streptomyces griseus," *J. Antibiot.*, 60(6):380-387 (2007).
Suzuki, "Phosphotransacetylase of *Escherichia coli* B, activation by pyruvate and inhibition by NADH and certain nucleotides," *Biochim. Biophys. Acta*, 191(3):559-569 (1969).
Takagi et al., "Isolation of a Versatile Serratia marcescens Mutant as a Host and Molecular Cloning of the Aspartase Gene," *J. Bacteriol.*, 161(1):1-6 (1985).
Takagi et al., "Purfication, Crystallization, and Molecular Properties of Aspartase from Pseudomonas fluorescens," *J. Biochem.*, 96:545-552 (1984).
Takahashi et al., "Metabolic Pathways for Cytoxic End Product Formation from Glutamate- and Aspartate-Containing Peptides by Porphyromonas gingivalis," *J. Bacteriol.*, 182(17):4704-4710 (2000).
Takatsuka et al., "Gene cloning and molecular characterization of lysine decarboxylase from Selenomonas ruminantium delineate its evolutionary relationship to ornithine decarboxylases from eukaryotes," *J. Bacteriol.*, 182(23):6732-6741 (2000).
Takatsuka et al., "Identification of the amino acid residues conferring substrate specificity upon selenomonas ruminantium lysine decarboxylase," *Biosci. Biotechnol. Biochem.*, 63(10):1843-1846 (1999).
Tamaki et al., "Purification, Properties, and Sequencing of Aminisobutyrate Aminotransferases from Rat Liver," *Meth. Enzymol.*, 324:376-389 (2000).
Tanaka et al., "Lysine decarboxylase of Vibrio parahaemolyticus: kinetics of transcription and role in acid resistance," *J. Appl. Microbiol.*, 104(5):1283-1293 (2007).
Tang et al., "Identification of a novel pyridoxal 5'-phosphaste binding site in adenosylcobalamin-dependent lysine 5,6-aminomutase from Porphyromonas gingivalis," *Biochemistry*, 41(27):8767-8776 (2002).
Tani et al., "Thermostable NADP(+)-dependent medium-chain alcohol dehydrogenase from Acinetobacter sp strain M-1: Purification and characterization and gene expression in *Escherichia coli*," *Appl. Environ. Microbiol.*, 66:5231-5235 (2000).
Ter Schure et al., "Pyruvate Decarboxylase Catalyzes Decarboxylation of Branched-Chaing 2-Oxo Acids but Is Not Essential for Fusel Alcohol Production by Saccharomyces cerevisiae," *Appl. Environ. Microbiol.*, 64(4):1303-1307 (1998).
Thauer, "Microbiology. A fifth pathway of carbon fixation," *Science*, 318:1732-1733 (2007).
Tian et al., "Variant tricarboxylic acid cycle in Mycobacterium tuberculosis: identification of alpha-ketoglutarate decarboxylase," *Proc. Natl. Acad. Sci. U.S.A.*, 102(30):10670-10675 (2005).
Tobin et al., "Localization of the lysine epsilon-aminotransferase (lat) and delta—(L-alpha-aminoadipyl)-L-cysteinyl-D-Valine synthetase (pcbAB) genes from Streptomyces clavuligerus and production of lysine epsilon-aminotransferase activity in *Escherichia coli*," *J. Bacteriol.*, 173(19):6223-6229 (1991).
Toth et al., "The ald gene, encoding a coenzyme A-acylating aldehyde dehydrogenase, distinguishes Clostridium beijerinckii and two other solvent-producing clostridia from Clostridium acetobutylicum," *Appl. Environ. Microbiol.*, 65(11):4973-4980 (1999).
Tretter et al., "Alpha-ketoglutarate dehydrogenase: a target and generator of oxidative stress," *Philos. Trans. R. Soc. Lond B. Biol. Sci.*, 360:2335-2345 (2005).
Tucci et al., "A novel prokaryotic trans-2-enoyl-CoA reductase from the spirochete Treponema denticola," *FEBS Lett.*, 581:1561-1566 (2007).
Twarog et al., "Role of Buyryl Phosphate in the Energy Metabolism of Clostridium Tetanomorphum," *J. Bacteriol.*, 86:112-117 (1963).
Uchiyama et al., "Identification of the4-Hydroxycinnamate Decarboxylase (PAD) Gene of Klebsiella oxytoca," *Biosci. Biotechnol. Biochem.*, 72:116-123 (2008).
UnipotAccession No. Q9RM86, "SubName: Full=4-Hydroybutyrate CoA-transferase," 1 page, 2000.
United States U.S. Appl. No. 12/794,700, Sequence 69, 2 pages, 2016.
Valentin et al., "Metabolic pathway for biosynthesis of poly(3-hydroxybutyrate-co-4-hydroxybutyrate) from 4-hydroxybutyrate by Alcaligenes eutrophus," *Eur. J. Biochem.*, 227(1-2):43-60 (1995).
Valentine et al., "Purification and role of phosphotransbutyrylase," *J. Biol. Chem.*, 235:1948-1952 (1960).
Vamecq et al., "The microsomal dicarboxylyl-CoA synthetase," *Biochem. J.*, 230:683-693 (1985).
Van Grinsven et al., "Acetate: Succinate CoA-transferase in the Hydrogenosomes of Trichomonas vaginalis," *J. Biol. Chem.*, 283:1411-1418 (2008).
Vanderwinkel et al., "Growth of Escherichia Coli on Fatty Acids: Requirement for Coenzyme a Transferase Activity," *Biochem. Biophys. Res. Commun.*, 33:902-908 (1968).
Vazquez et al., "Phosphotransbutyrylase Expression in Bacillus megaterium," *Curr. Microbiol.*, 42:345-349 (2001).
Venkitasubramanian et al. *Biocatalysis in the Pharmaceutical and Biotechnology Industries*, ed. R.N. Patel, Chapter 15, pp. 425-440, CRC Press LLC, Boca Raton, Fl. 2007.
Venkitasubramanian et al., "Reduction of Carboxylic Acids by Nocardia Aldehyde Oxidoreductase Requires a Phosphopantetheinylated Enzyme," *J. Biol Chem.*, 282:478-485 (2007).
Vernal et al., "Cloning and heterologous expression of a broad specificity aminotransferase of leishmania mexicana promastigotes1," *FEMS Microbiol. Lett.*, 229(2):217-222 (2003).
Vernal et al., "Isolation and partial characterization of a broad specificity aminotransferase from Leishmania mexicana promastigotes," *Mol. Biochem. Parasitol.*, 96(1-2):83-92 (1998).
Viola, "L-aspartase: new tricks from an old enzyme," *Adv. Enzymol. Relat. Areas. Mol. Biol.*, 74:295-341 (2000).
Volkov et al., "Random chimeragenesis by heteroduplex recombination," *Methods Enzymol.*, 328:456-463 (2000).
Volkov et al., "Recombination and chimeragenesis by in vitro heteroduplex formation and in vivo repair," *Nucleic Acids Res.*, 27(18):e18 (1999).
Walter et al., "Sequence and arrangement of two genes of the butyrate-synthesis pathway of Clostridium acetobutylicum ATCC 824," *Gene*, 134:107-111 (1993).
Walter et al., "Molecular characterization of two Clostridium acetobutylicum ATCC 824 butanol dehydrogenase isozyme genes," *J. Bacteriol.*, 174(22):7149-7158 (1992).
Wang et al., "Molecular cloning and functional identification of a novel phenylacetyl-CoA ligase gene from Penicillium chrysogenum," *Biochem. Biophys. Res. Commun.*, 360(2):453-458 (2007).
Wang et al., "The primary structure of branched-chain α-oxo acid dehydrogenase from Bacillus subtilis and its similarity to other α-oxo acid dehydrogenases," *Eur. J. Biochem.*, 213:1091-1099 (1993).
Wang et al., "Activation of Silent Genes by Transposons Tn5 and Tn10," *Genetics*, 120(4):875-885 (1988).

(56) References Cited

OTHER PUBLICATIONS

Wang et al., "Overview of Regulatory Strategies and Molecular Elements in Metabolic Engineering of Bacteria," *Mol. Biotechnol.*, 52(2):300-308 (2012).
Ward et al., "Molecular analysis of the role of two aromatic aminotransferases and a broad-specificity aspartate aminotransferase in the aromatic amino acid metabolism of Pyrococcus furiosus," *Archaea*, 1:133-141 (2002).
Weaver, "Structure of free fumarase C from *Eschericiha coli*," *Acta. Crystallog. D. Biol. Crystallogr.*, 61:1395-1401 (2005).
Welch et al., "Purification and characterization of the NADH-dependent butanol dehydrogenase from Clostridium acetobutylicum (ATCC 824)," *Arch. Biochem. Biophys.*, 273(2):309-318 (1989).
Westin et al., "The Identification of Succinyl-CoA Thioesterase Suggests a Novel Pathway for Succinate Production in Peroxisomes," *J. Biol. Chem.*, 280(46):38125-38132 (2005).
Whalen et al., "Analysis of an avtA :: Mu dl (Ap lac) Mutant: Metabolic role of Transaminase C," *J. Bacteriol.*, 150(2): 739-746 (1982).
Whalen et al., "Gratuitous Repression of avtA in *Escherichia coli* and Salmonella typhimurium," *J. Bacteriol.*, 158(2):571-574 (1984).
Wieland et al., "Engineering of ribozyme-based riboswitches for mammalian cells," *Methods*, 56(3):351-357 (2012).
Wiesenborn et al., "Coenzyme A Transferase from Clostridium acetobutylicum ATC 824 and Its Role in the Uptake of Acids," *Appl. Environ. Microbiol.*, 55:323-329 (1989).
Wilkie et al., "Recombinant Expression, Purification, and Characterization of Three Isoenzymes of Aspartate Aminotransferase from Arabidopsis thaliana," *Protein Expr. Purif.*, 12:381-389 (1998).
Wilks et al., "A specific, highly active malate dehydrogenase by redesign of a lactate dehydrogenase framework," *Science*, 242(4885):1541-1544 (1988).
Wilks et al., "Design for a broad substrate specificity keto acid dehydrogenase," *Biochemistry*, 29(37):8587-8591 (1990).
Wilks et al., "Design of a specific phenyllactate dehydrogenase by peptide loop exchange on the Bacillus stearothermophilus lactate dehydrogenase framework," *Biochemistry*, 31(34):7802-7806 (1992).
Willke et al., "Biotechnological production of itaconic acid," *Appl. Microbiol. Biotechnol.*, 56:289-295 (2001).
Wolff et al., "Purification and characterization of the oxygen-sensitive 4-hydroxybutanoate dehydrogenase from Clostridium kluyveri," *Protein Expr. Purif.*, 6:206-212 (1995).
Wong et al., "Sequence satruation mutagenesis with tunable mutation frequencies," *Anal. Biochem.*, 341:187-189 (2005).
Wong et al., "Sequence saturation mutagenesis (SeSaM): a novel method for directed evolution," *Nucleic Acids Res.*, 32(3):e26 (2004).
Wong et al., "Transversion-enriched sequence saturation mutagenesis (SeSaM-Tv+): a random mutagenesis method with consecutive nucleotide exchanges that complements the bias of error-prone PCR," *Biotechnol. J.*, 3:74-82 (2008).
Wynn et al., "Chaperonins GroEL and GroES Promote Assembly of Heterotramers ($\alpha 2 \beta 2$) of Mammalian Mitochondrial Branched-chain $\alpha$-Keto Acid Decarboxylase in *Escherichia coli*," *J. Biol. Chem.*, 267(18):12400-12403 (1992).
Wynn et al., "Cloning and Expression in *Escherichia coli* of a Mature El$\beta$ Subunit of Bovine Mitochondrial Branched-chain $\alpha$-Keto Acid Dehydrogenase Complex," *J. Biol Chem.*, 267(3):1881-1887 (1992).
Yagi et al., "Aspartate: 2-Oxoglutarate Aminotransferase from Bakers' Yeast: Crystallization and Characterization," *J. Biochem.*, 92:35-43 (1982).
Yagi et al., "Crystallization and Properties of Aspartate Aminotransferase from *Escherichi coli* B," *FEBS Lett.*, 100(1)81-84 (1979).
Yagi et al., "Glutamate-Aspartate Transaminase from Microorganisms," *Meth. Enzymol.*, 113:83-89 (1985).
Yang et al., "Nucleotide Sequence of the fadA Gene. Primary structure of 3-ketoacyl-coenzyme A thiolase from Escherichia coli and the structural organization of the fadAB operon," *J. Biol. Chem.*, 265(18):10424-10429 (1990) with correction in *J. Biol. Chem.* 266(24):16255 (1991).
Yang et al., "Aspartate Dehydrogenase, a Novel Enszyme Idnetified from Structural and Functional Studies of TM16343," *J. Biol. Chem.*, 278:8804-8808 (2003).
Yang et al., "Nucleotide sequence of the promoter and fadB gene of the fadBA operon and primary structure of the multifunctional fatty acid oxidation protein from *Escherichia coli*," *Biochemistry*, 30(27):6788-6795 (1991).
Yang et al., "Collaborative spirit of histone deacetylases in regulating chromatin structure and gene expression," *Curr. Opin. Genet. Dev.*, 13(2):143-153 (2003).
Yang et al., "Nucleotide sequence of the fadA gene: Primary structure of 3-ketoacyl-coenzyme A thiolase from *Escherichia coli* and the structural organization of the fadAB operon," *J. Biol. Chem.*, 265(18): p. 10424-10429 (1990).
Yano et al., "Directed evolution of an aspartate aminotransferase with new substrate specificities," *Proc. Natl. Acad. Sci. U.S.A.*, 95:5511-5515 (1998).
Yarlett et al., "Trichomonas vaginalis: characterization of ornithine decarboxylase," *Biochem. J.*, 293:487-493 (1993).
Yim et al., "Metabolic engineering of Escherichia coli for direct production of 1,4-butanediol," *Nature Chemical Biology*, 7(7):445-452 (2011).
Yoshida et al., "The structures of L-rhamnose isomerase from Pseudomonas stutzeri in complexes with L-rhamnose and D-allose provide insights into broad substrate specificity," *J. Mol. Biol.*, 365(5):1505-1516 (2007).
Yuan et al., "Prokaryotic ubiquitin-like This fusion enhances the heterologous protein overexpression and aggregation in *Escherichia coli*," *PLoS One*, 8(4):e62529 (2013).
Yun et al., "Enhancement of lactate and succinate formation in adhE or pta-ackA mutants of NADH dehydrogenase-deficient *Escherichia coli*," *J. Appl. Microbiol.*, 99:1404-1412 (2005).
Yun et al., "$\omega$-Amino acid:pyruvate transaminase from Alcaligenes denitrificans Y2k-2: a new catalyst for kinetic resolution of $\beta$-amino acids and amines," *Appl. Environ. Microbiol.*, 70(4):2529-2534 (2004).
Zeiher et al., "Identification and Characterization of Mitochondrial Acetyl-Coenzyme A Hydrolase from *Pisum sativum* L. Seedlings," *Plant Physiol.*, 94:20-27 (1990).
Zhang et al., "2-Oxoacid: Ferredoxin Oxidoreductase from the Thermoacidophilic Archaeon, *Sulfolobus* sp. Strain 7," *J. Biochem.*, 120:587-599 (1996).
Zhang et al., "Directed evolution of a fucosidase from a galactosidase by DNA shuffling and screening," *Proc. Natl. Acad. Sci. U.S.A.*, 94:4504-4509 (1997).
Zhao et al., "Molecular evolution by staggered extension process (StEP) in vitro recombination," *Nat. Biotechnol.*, 16(3):258-261 (1998).
Zhou et al., "Engineering a native homoethanol pathway in *Escherichia coli* B for ethanol production," *Biotechnol. Lett.*, 30:335-342 (2008).
Zhou et al., "The remarkable structural and functional organization of the eukaryotic pyruvate dehydrogenase complexes," *Proc. Natl. Acad. Sci. U.S.A.*, 98:14802-14807 (2001).
Zhuang et al., "The YbgC protein encoded by the ybgC gene of the tol-pal gene cluster of Haemophilus influenzae catalyzes acyl-coenzyme A thioester hydrolysis," *FEBS Lett.*, 516:161-163 (2002).

\* cited by examiner

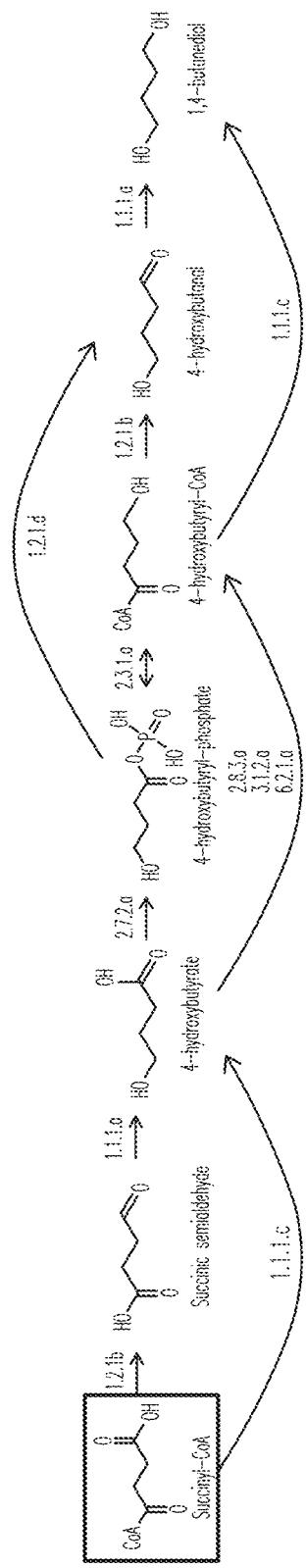
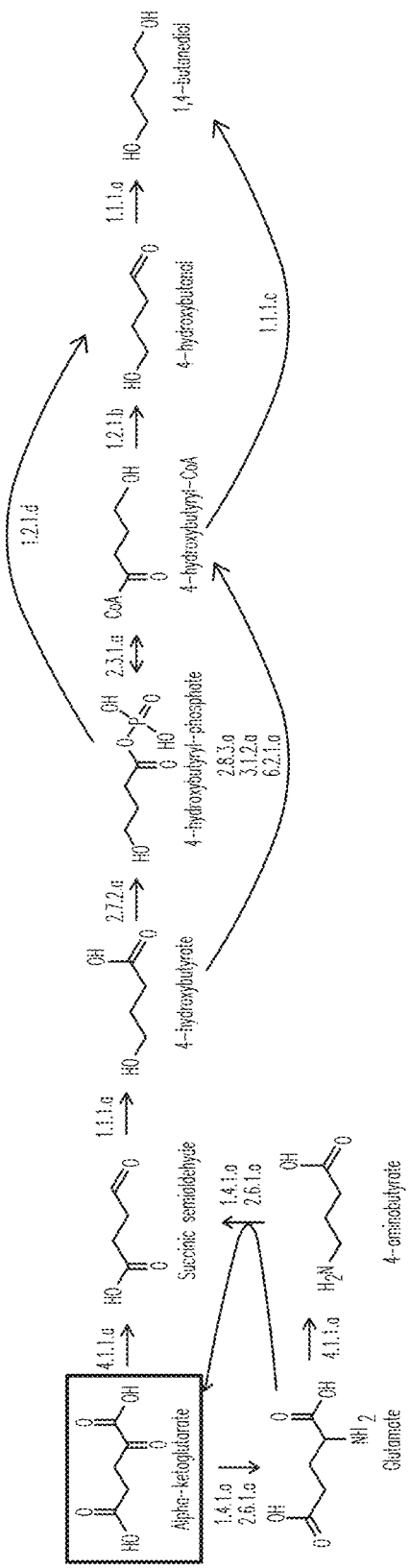
FIG. 8A
FIG. 8B

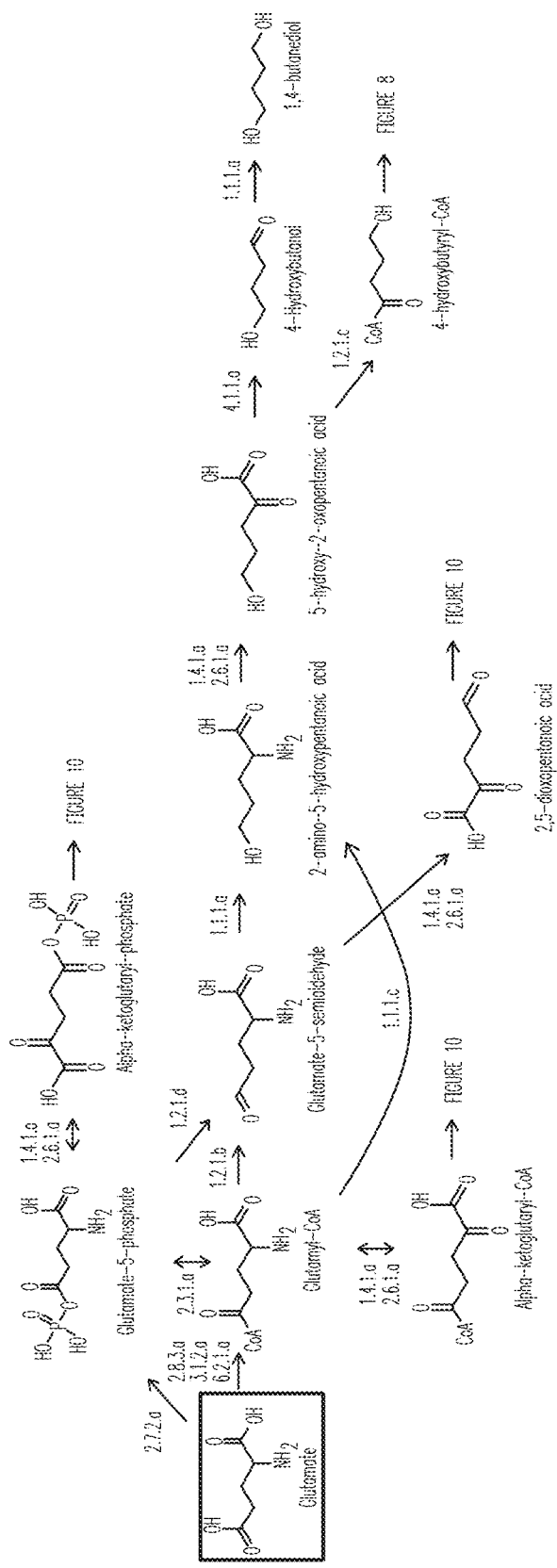
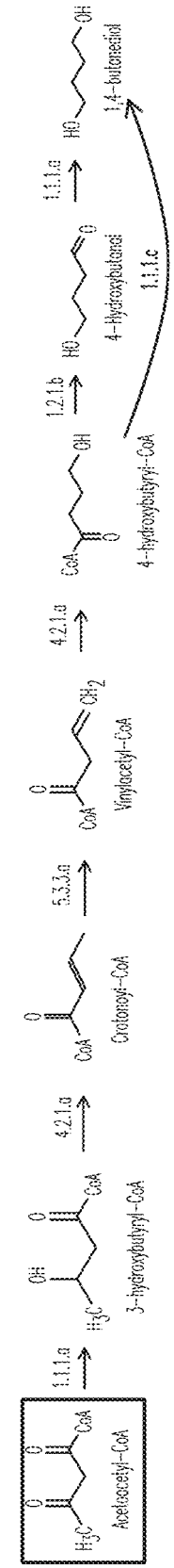
FIG. 11
FIG. 12

FIG. 14A

ATGAACTTACATGAATATCAGGCAAAACAACTTTTTGCCCGCTATGGCTTACCAGCACCGGTGGGTTATG
CCTGTACTACTCCGCGCGAAGCAGAAGAAGCCGCTTCAAAAATCGGTGCCGGTCCGTGGGTAGTGAAAT
GTCAGGTTCACGCTGGTGGCCGCGGTAAAGCGGGCGGTGTGAAAGTTGTAAACAGCAAAGAAGACATC
CGTGCTTTTGCAGAAAACTGGCTGGGCAAGCGTCTGGTAACGTATCAAACAGATGCCAATGGCCAACCG
GTTAACCAGATTCTGGTTGAAGCAGCGACCGATATCGCTAAAGAGCTGTATCTCGGTGCCGTTGTTGAC
CGTAGTTCCCGTCGTGTGGTCTTTATGGCCTCCACCGAAGGCGGCGTGGAAATCGAAAAAGTGGCGGA
AGAAACTCCGCACCTGATCCATAAAGTTGCGCTTGATCCGCTGACTGGCCCGATGCCGTATCAGGGACG
CGAGCTGGCGTTCAAACTGGGTCTGGAAGGTAAACTGGTTCAGCAGTTCACCAAAATCTTCATGGGCCT
GGCGACCATTTTCCTGGAGCGCGACCTGGCGTTGATCGAAATCAACCCGCTGGTCATCACCAAACAGGG
CGATCTGATTTGCCTCGACGGCAAACTGGGCGCTGACGGCAACGCACTGTTCCGCCAGCCTGATCTGCG
CGAAATGCGTGACCAGTCGCAGGAAGATCCGCGTGAAGCACAGGCTGCACAGTGGGAACTGAACTACG
TTGCGCTGGACGGTAACATCGGTTGTATGGTTAACGGCGCAGGTCTGGCGATGGGTACGATGGACATC
GTTAAACTGCACGGCGGCGAACCGGCTAACTTCCTTGACGTTGGCGGCGGCGCAACCAAAGAACGTGT
AACCGAAGCGTTCAAAATCATCCTCTCTGACGACAAAGTGAAAGCCGTTCTGGTTAACATCTTCGGCGGT
ATCGTTCGTTGCGACCTGATCGCTGACGGTATCATCGGCGCGGTAGCAGAAGTGGGTGTTAACGTACCG
GTCGTGGTACGTCTGGAAGGTAACAACGCCGAACTCGGCGCGAAGAAACTGGCTGACAGCGGCCTGAA
TATTATTGCAGCAAAAGGTCTGACGGATGCAGCTCAGCAGGTTGTTGCCGCAGTGGAGGGGAAATAAT
GTCCATTTTAATCGATAAAAACACCAAGGTTATCTGCCAGGGCTTTACCGGTAGCCAGGGGACTTTCCAC
TCAGAACAGGCCATTGCATACGGCACTAAAATGGTTGGCGGCGTAACCCCAGGTAAAGGCGGCACCAC
CCACCTCGGCCTGCCGGTGTTCAACACCGTGCGTGAAGCCGTTGCTGCCACTGGCGCTACCGCTTCTGTT
ATCTACGTACCAGCACCGTTCTGCAAAGACTCCATTCTGGAAGCCATCGACGCAGGCATCAAACTGATTA
TCACCATCACTGAAGGCATCCCGACGCTGGATATGCTGACCGTGAAAGTGAAGCTGGATGAAGCAGGC
GTTCGTATGATCGGCCCGAACTGCCCAGGCGTTATCACTCCGGGTGAATGCAAAATCGGTATCCAGCCT
GGTCACATTCACAAACCGGGTAAAGTGGGTATCGTTTCCCGTTCCGGTACACTGACCTATGAAGCGGTT
AAACAGACCACGGATTACGGTTTCGGTCAGTCGACCTGTGTCGGTATCGGCGGTGACCCGATCCCGGGC
TCTAACTTTATCGACATTCTCGAAATGTTCGAAAAAGATCCGCAGACCGAAGCGATCGTGATGATCGGT
GAGATCGGCGGTAGCGCTGAAGAAGAAGCAGCTGCGTACATCAAGAGCACGTTACCAAGCCAGTTGT
GGGTTACATCGCTGGTGTGACTGCGCCGAAAGGCAAACGTATGGGCCACGCGGGTGCCATCATTGCCG
GTGGGAAAGGGACTGCGGATGAGAAATTCGCTGCTCTGGAAGCCGCAGGCGTGAAAACCGTTCGCAGC
CTGGCGGATATCGGTGAAGCACTGAAAACTGTTCTGAAATAA

FIG. 14B

MNLHEYQAKQLFARYGLPAPVGYACTTPREAEEAASKIGAGPWVVKCQVHAGGRGKAGGVKVVNSKEDIR
AFAENWLGKRLVTYQTDANGQPVNQILVEAATDIAKELYLGAVVDRSSRRVVFMASTEGGVEIEKVAEETPH
LIHKVALDPLTGPMPYQGRELAFKLGLEGKLVQQFTKIFMGLATIFLERDLALIEINPLVITKQGDLICLDGKLGA
DGNALFRQPDLREMRDQSQEDPREAQAAQWELNYVALDGNIGCMVNGAGLAMGTMDIVKLHGGEPAN
FLDVGGGATKERVTEAFKIILSDDKVKAVLVNIFGGIVRCDLIADGIIGAVAEVGVNVPVVVRLEGNNAELGAK
KLADSGLNIIAAKGLTDAAQQVVAAVEGK

FIG. 14C

MSILIDKNTKVICQGFTGSQGTFHSEQAIAYGTKMVGGVTPKGGTTHLGLPVFNTVREAVAATGATASVIY
VPAPFCKDSILEAIDAGIKLIITITEGIPTLDMLTVKVKLDEAGVRMIGPNCPGVITPGECKIGIQPGHIHKPGKV
GIVSRSGTLTYEAVKQTTDYGFGQSTCVGIGGDPIPGSNFIDILEMFEKDPQTEAIVMIGEIGGSAEEEAAAYIK
EHVTKPVVGYIAGVTAPKGKRMGHAGAIIAGGKGTADEKFAALEAAGVKTVRSLADIGEALKTVLK

FIG. 15A

```
ATGGCCAACATAAGTTCACCATTCGGGCAAAACGAATGGCTGGTTGAAGAGATGTACCGCAAGTTCCGC
GACGACCCCTCCTCGGTCGATCCCAGCTGGCACGAGTTCCTGGTTGACTACAGCCCCGAACCCACCTCCC
AACCAGCTGCCGAACCAACCCGGGTTACCTCGCCACTCGTTGCCGAGCGGGCCGCTGCGGCCGCCCCGC
AGGCACCCCCAAGCCGGCCGACACCGCGGCCGCGGGCAACGGCGTGGTCGCCGCACTGGCCGCCAAA
ACTGCCGTTCCCCGCCAGCCGAAGGTGACGAGGTAGCGGTGCTGCGCGGCGCCGCCGCGGCCGTCGT
CAAGAACATGTCCGCGTCGTTGGAGGTGCCGACGGCGACCAGCGTCCGGGCGGTCCCGGCCAAGCTAC
TGATCGACAACCGGATCGTCATCAACAACCAGTTGAAGCGGACCCGCGGCGGCAAGATCTCGTTCACGC
ATTTGCTGGGCTACGCCCTGGTGCAGGCGGTGAAGAAATTCCCGAACATGAACCGGCACTACACCGAA
GTCGACGGCAAGCCCACCGCGGTCACGCCGGCGCACACCAATCTCGGCCTGGCGATCGACCTGCAAGG
CAAGGACGGGAAGCGTTCCCTGGTGGTGGCCGGCATCAAGCGGTGCGAGACCATGCGATTCGCGCAGT
TCGTCACGGCCTACAAGACATCGTACGCCGGGCCGCGACGGCAAGCTGACCACTGAAGACTTTGCCG
GCGTGACGATTTCGCTGACCAATCCCGGAACCATCGGCACCGTGCATTCGGTGCCGCGGCTGATGCCCG
GCCAGGGCGCCATCATCGGCGTGGGCGCCATGGAATACCCCGCCGAGTTTCAAGGCGCCAGCGAGGAA
CGCATCGCCGAGCTGGGCATCGGCAAATTGATCACTTTGACCTCCACCTACGACCACCGCATCATCCAGG
GCGCGGAATCGGGCGACTTCCTGCGCACCATCCACGAGTTGCTGCTCTCGGATGGCTTCTGGGACGAGG
TCTTCCGCGAACTGAGCATCCCATATCTGCCGGTGCGCTGGAGCACCGACAACCCCGACTCGATCGTCG
ACAAGAACGCTCGCGTCATGAACTTGATCGCGGCCTACCGCAACCGCGGCCATCTGATGGCCGATACCG
ACCCGCTGCGGTTGGACAAAGCTCGGTTCCGCAGTCACCCCGACCTCGAAGTGCTGACCCACGGCCTGA
CGCTGTGGGATCTCGATCGGGTGTTCAAGGTCGACGGCTTTGCCGGTGCGCAGTACAAGAAACTGCGC
GACGTGCTGGGCTTGCTGCGCGATGCCTACTGCCGCCACATCGGCGTGGAGTACGCCCATATCCTCGAC
CCCGAACAAAAGGAGTGGCTCGAACAACGGGTCGAGACCAAGCACGTCAAACCCACTGTGGCCCAACA
GAAATACATCCTCAGCAAGCTCAACGCCGCCGAGGCCTTTGAAACGTTCCTACAGACCAAGTACGTCGG
CCAGAAGCGGTTCTCGCTGGAAGGCGCCGAAAGCGTGATCCCGATGATGGACGCGGCGATCGACCAGT
GCGCTGAGCACGGCCTCGACGAGGTGGTCATCGGGATGCCGCACCGGGGCCGGCTCAACGTGCTGGCC
AACATCGTCGGCAAGCCGTACTCGCAGATCTTCACCGAGTTCGAGGGCAACCTGAATCCGTCGCAGGCG
CACGGCTCCGGTGACGTCAAGTACCACCTGGGCGCCACCGGGCTGTACCTGCAGATGTTCGGCGACAAC
GACATTCAGGTGTCGCTGACCGCCAACCCGTCGCATCTGGAGGCCGTCGACCCGGTGCTGGAGGGATT
GGTGCGGGCCAAGCAGGATCTGCTCGACCACGAAGCATCGACAGCGACGGCCAACGGGCGTTCTCGG
TGGTGCCGCTGATGTTGCATGGCGATGCCGCGTTCGCCGGTCAGGGTGTGGTCGCCGAGACGCTGAAC
CTGGCGAATCTGCCGGGCTACCGCGTCGGCGGCACCATCCACATCATCGTCAACAACCAGATCGGCTTC
ACCACCGCGCCCGAGTATTCCAGGTCCAGCGAGTACTGCACCGACGTCGCAAAGATGATCGGGGCACC
GATCTTTCACGTCAACGGCGACGACCCGGAGGCGTGTGTCTGGGTGGCGCGGTTGGCGGTGGACTTCC
GACAACGGTTCAAGAAGGACGTCGTCATCGACATGCTGTGCTACCGCCGCCGCGGGCACAACGAGGGT
GACGACCCGTCGATGACCAACCCCTACATGTACGACGTCGTCGACACCAAGCGCGGGGCCCGCAAAAG
CTACACCGAAGCCCTGATCGGACGTGGCGACATCTCGATGAAGGAGGCCGAGGACGCGCTGCGCGACT
ACCAGGGCCAGCTGGAACGGGTGTTCAACGAAGTGCGCGAGCTGGAGAAGCACGGTGTGCAGCCGAG
CGAGTCGGTCGAGTCCGACCAGATGATTCCCGCGGGGCTGGCCACTGCGGTGGACAAGTCGCTGCTGG
CCCGGATCGGCGATGCGTTCCTCGCCTTGCCGAACGGCTTCACCGCGCACCCGCGAGTCCAACCGGTGC
TGGAGAAGCGCCGGGAGATGGCCTATGAAGGCAAGATCGACTGGGCCTTTGGCGAGCTGCTGGCGCT
GGGCTCGCTGGTGGCCGAAGGCAAGCTGGTGCGCTTGTCGGGGCAGGACAGCCGCCGCGGCACCTTCT
CCCAGCGGCATTCGGTTCTCATCGACCGCCACACTGGCGAGGAGTTCACACCACTGCAGCTGCTGGCGA
CCAACTCCGACGGCAGCCCGACCGGCGGAAAGTTCCTGGTCTACGACTCGCCACTGTCGGAGTACGCCG
CCGTCGGCTTCGAGTACGGCTACACTGTGGGCAATCCGGACGCCGTGGTGCTCTGGGAGGCGCAGTTC
```

FIG. 15A continued

GGCGACTTCGTCAACGGCGCACAGTCGATCATCGACGAGTTCATCAGCTCCGGTGAGGCCAAGTGGGG
CCAATTGTCCAACGTCGTGCTGCTGTTACCGCACGGGCACGAGGGGCAGGGACCCGACCACACTTCTGC
CCGGATCGAACGCTTCTTGCAGTTGTGGGCGGAAGGTTCGATGACCATCGCGATGCCGTCGACTCCGTC
GAACTACTTCCACCTGCTACGCCGGCATGCCCTGGACGGCATCCAACGCCGCTGATCGTGTTCACGCCC
AAGTCGATGTTGCGTCACAAGGCCGCCGTCAGCGAAATCAAGGACTTCACCGAGATCAAGTTCCGCTCA
GTGCTGGAGGAACCCACCTATGAGGACGGCATCGGAGACCGCAACAAGGTCAGCCGGATCCTGCTGAC
CAGTGGCAAGCTGTATTACGAGCTGGCCGCCCGCAAGGCCAAGGACAACCGCAATGACCTCGCGATCG
TGCGGCTTGAACAGCTCGCCCCGCTGCCCAGGCGTCGACTGCGTGAAACGCTGGACCGCTACGAGAAC
GTCAAGGAGTTCTTCTGGGTCCAAGAGGAACCGGCCAACCAGGGTGCGTGGCCGCGATTCGGGCTCGA
ACTACCCGAGCTGCTGCCTGACAAGTTGGCCGGGATCAAGCGAATCTCGCGCCGGGCGATGTCAGCCCC
GTCGTCAGGCTCGTCGAAGGTGCACGCCGTCGAACAGCAGGAGATCCTCGACGAGGCGTTCGGCTAA

FIG. 15B

MANISSPFGQNEWLVEEMYRKFRDDPSSVDPSWHEFLVDYSPEPTSQPAAEPTRVTSPLVAERAAAAAPQA
PPKPADTAAAGNGVVAALAAKTAVPPPAEGDEVAVLRGAAAAVVKNMSASLEVPTATSVRAVPAKLLIDNR
IVINNQLKRTRGGKISFTHLLGYALVQAVKKFPNMNRHYTEVDGKPTAVTPAHTNLGLAIDLQGKDGKRSLV
VAGIKRCETMRFAQFVTAYEDIVRRARDGKLTTEDFAGVTISLTNPGTIGTVHSVPRLMPGQGAIIGVGAME
YPAEFQGASEERIAELGIGKLITLTSTYDHRIIQGAESGDFLRTIHELLLSDGFWDEVFRELSIPYLPVRWSTDNP
DSIVDKNARVMNLIAAYRNRGHLMADTDPLRLDKARFRSHPDLEVLTHGLTWDLDRVFKVDGFAGAQYKK
LRDVLGLLRDAYCRHIGVEYAHILDPEQKEWLEQRVETKHVKPTVAQQKYILSKLNAAEAFETFLQTKYVGQK
RFSLEGAESVIPMMDAAIDQCAEHGLDEVVIGMPHRGRLNVLANIVGKPYSQIFTEFEGNLNPSQAHGSGD
VKYHLGATGLYLQMFGDNDIQVSLTANPSHLEAVDPVLEGLVRAKQDLLDHGSIDSDGQRAFSVVPLMLHG
DAAFAGQGVVAETLNLANLPGYRVGGTIHIIVNNQIGFTTAPEYSRSSEYCTDVAKMIGAPIFHVNGDDPEAC
VWVARLAVDFRQRFKKDVVIDMLCYRRRGHNEGDDPSMTNPYMYDVVDTKRGARKSYTEALIGRGDISM
KEAEDALRDYQGQLERVFNEVRELEKHGVQPSESVESDQMIPAGLATAVDKSLLARIGDAFLALPNGFTAHP
RVQPVLEKRREMAYEGKIDWAFGELLALGSLVAEGKLVRLSGQDSRRGTFSQRHSVLIDRHTGEEFTPLQLLA
TNSDGSPTGGKFLVYDSPLSEYAAVGFEYGYTVGNPDAVVLWEAQFGDFVNGAQSIIDEFISSGEAKWGQLS
NVVLLLPHGHEGQGPDHTSARIERFLQLWAEGSMTIAMPSTPSNYFHLLRRHALDGIQRPLIVFTPKSMLRH
KAAVSEIKDFTEIKFRSVLEEPTYEDGIGDRNKVSRILLTSGKLYYELAARKAKDNRNDLAIVRLEQLAPLPRRRL
RETLDRYENVKEFFWVQEEPANQGAWPRFGLELPELLPDKLAGIKRISRRAMSAPSSGSSKVHAVEQQEILDE
AFG

FIG. 18A

ATGGAAATCAAAGAAATGGTGAGCCTTGCACGCAAGGCTCAGAAGGAGTATCAAGCTACCCATAACCA
AGAAGCAGTTGACAACATTTGCCGAGCTGCAGCAAAAGTTATTTATGAAAATGCAGCTATTCTGGCTCG
CGAAGCAGTAGACGAAACCGGCATGGGCGTTTACGAACACAAAGTGGCCAAGAATCAAGGCAAATCCA
AAGGTGTTTGGTACAACCTCCACAATAAAAAATCGATTGGTATCCTCAATATAGACGAGCGTACCGGTAT
GATCGAGATTGCAAAGCCTATCGGAGTTGTAGGAGCCGTAACGCCGACGACCAACCCGATCGTTACTCC
GATGAGCAATATCATCTTTGCTCTTAAGACCTGCAATGCCATCATTATTGCCCCCACCCCAGATCCAAAA
AATGCTCTGCACACGCAGTTCGTCTGATCAAAGAAGCTATCGCTCCGTTCAACGTACCGGAAGGTATGG
TTCAGATCATCGAAGAACCCAGCATCGAGAAGACGCAGGAACTCATGGGCGCCGTAGACGTAGTAGTT
GCTACGGGTGGTATGGGCATGGTGAAGTCTGCATATTCTTCAGGAAAGCCTTCTTTCGGTGTTGGAGCC
GGTAACGTTCAGGTGATCGTGGATAGCAACATCGATTTCGAAGCTGCTGCAGAAAAAATCATCACCGGT
CGTGCTTTCGACAACGGTATCATCTGCTCAGGCGAACAGAGCATCATCTACAACGAGGCTGACAAGGAA
GCAGTTTTCACAGCATTCCGCAACCACGGTGCATATTTCTGTGACGAAGCCGAAGGAGATCGGGCTCGT
GCAGCTATCTTCGAAAATGGAGCCATCGCGAAAGATGTAGTAGGTCAGAGCGTTGCCTTCATTGCCAAG
AAAGCAAACATCAATATCCCCGAGGGTACCCGTATTCTCGTTGTTGAAGCTCGCGGCGTAGGAGCAGAA
GACGTTATCTGTAAGGAAAAGATGTGTCCCGTAATGTGCGCCCTCAGCTACAAGCACTTCGAAGAAGGT
GTAGAAATCGCACGTACGAACCTCGCCAACGAAGGTAACGGCCACACCTGTGCTATCCACTCCAACAAT
CAGGCACACATCATCCTCGCAGGATCAGAGCTGACGGTATCTCGTATCGTAGTAATGCTCCGAGTGCC
ACTACAGCAGGCGGTCACATCCAAAACGGTCTTGCCGTAACCAATACGCTCGGATGCGGATCATGGGGT
AATAACTCTATCTCCGAGAACTTCACTTACAAGCACCTCCTCAACATTTCACGCATCGCACCGTTGAATTC
AAGCATTCACATCCCCGATGACAAAGAAATCTGGGAACTCTAA

FIG. 18B

MEIKEMVSLARKAQKEYQATHNQEAVDNICRAAAKVIYENAAILAREAVDETGMGVYEHKVAKNQGKSKG
VWYNLHNKKSIGILNIDERTGMIEIAKPIGVVGAVTPTTNPIVTPMSNIIFALKTCNAIIIAPHPRSKKCSAHAVR
LIKEAIAPFNVPEGMVQIIEEPSIEKTQELMGAVDVVVATGGMGMVKSAYSSGKPSFGVGAGNVQVIVDSNI
DFEAAAEKIITGRAFDNGIICSGEQSIIYNEADKEAVFTAFRNHGAYFCDEAEGDRARAAIFENGAIAKDVVGQ
SVAFIAKKANINIPEGTRILVVEARGVGAEDVICKEKMCPVMCALSYKHFEEGVEIARTNLANEGNGHTCAIHS
NNQAHIILAGSELTVSRIVVNAPSATTAGGHIQNGLAVTNTLGCGSWGNNSISENFTYKHLLNISRIAPLNSSI
HIPDDKEIWEL

FIG. 19A

ATGCAACTTTTCAAACTCAAGAGTGTAACACATCACTTTGACACTTTTGCAGAATTTGCCAAGGAATTCTG
TCTTGGAGAACGCGACTTGGTAATTACCAACGAGTTCATCTATGAACCGTATATGAAGGCATGCCAGCTC
CCCTGCCATTTTGTTATGCAGGAGAAATATGGGCAAGGCGAGCCTTCTGACGAAATGATGAATAACATC
TTGGCAGACATCCGTAATATCCAGTTCGACCGCGTAATCGGTATCGGAGGAGGTACGGTTATTGACATC
TCTAAACTTTTCGTTCTGAAAGGATTAAATGATGTACTCGATGCATTCGACCGCAAAATACCTCTTATCAA
AGAGAAAGAACTGATCATTGTGCCCACAACATGCGGAACGGGTAGCGAGGTGACGAACATTTCTATCG
CAGAAATCAAAAGCCGTCACACCAAAATGGGATTGGCTGACGATGCCATTGTTGCAGACCATGCCATCA
TCATACCTGAACTTCTGAAGAGCTTGCCTTTCCACTTCTACGCATGCAGTGCAATCGATGCTCTTATCCAT
GCCATCGAGTCATACGTATCTCCTAAAGCCAGTCCATATTCTCGTCTGTTCAGTGAGGCGGCTTGGGACA
TTATCCTGGAAGTATTCAAGAAAATCGCCGAACACGGCCCTGAATACCGCTTCGAAAAGCTGGGAGAAA
TGATCATGGCCAGCAACTATGCCGGTATAGCCTTCGGAAATGCAGGAGTAGGAGCCGTCCACGCACTAT
CCTACCCGTTGGGAGGCAACTATCACGTGCCGCATGGAGAAGCAAACTATCAGTTCTTCACAGAGGTAT
TCAAAGTATACCAAAAGAAGAATCCTTTCGGCTATATAGTCGAACTCAACTGGAAGCTCTCCAAGATACT
GAACTGCCAGCCCGAATACGTATATCCGAAGCTGGATGAACTTCTCGGATGCCTTCTTACCAAGAAACCT
TTGCACGAATACGGCATGAAGGACGAAGAGGTAAGAGGCTTTGCGGAATCAGTGCTTAAGACACAGCA
AAGATTGCTCGCCAACAACTACGTAGAGCTTACTGTAGATGAGATCGAAGGTATCTACAGAAGACTCTA
CTAA

FIG. 19B

MQLFKLKSVTHHFDTFAEFAKEFCLGERDLVITNEFIYEPYMKACQLPCHFVMQEKYGQGEPSDEMMNNIL
ADIRNIQFDRVIGIGGGTVIDISKLFVLKGLNDVLDAFDRKIPLIKEKELIIVPTTCGTGSEVTNISIAEIKSRHTKM
GLADDAIVADHAIIIPELLKSLPFHFYACSAIDALIHAIESYVSPKASPYSRLFSEAAWDIILEVFKKIAEHGPEYRFE
KLGEMIMASNYAGIAFGNAGVGAVHALSYPLGGNYHVPHGEANYQFFTEVFKVYQKKNPFGYIVELNWKLS
KILNCQPEYVYPKLDELLGCLLTKKPLHEYGMKDEEVRGFAESVLKTQQRLLANNYVELTVDEIEGIYRRLY

FIG. 20A

ATGAAAGACGTATTAGCGGAATATGCCTCCCGAATTGTTTCGGCCGAAGAAGCCGTAAAACATATCAAA
AATGGAGAACGGGTAGCTTTGTCACATGCTGCCGGAGTTCCTCAGAGTTGTGTTGATGCACTGGTACAA
CAGGCCGACCTTTTCCAGAATGTCGAAATTTATCACATGCTTTGTCTCGGCGAAGGAAAATATATGGCAC
CTGAAATGGCCCCTCACTTCCGACACATAACCAATTTTGTAGGTGGTAATTCTCGTAAAGCAGTTGAGGA
AAATAGAGCCGACTTCATTCCGGTATTCTTTTATGAAGTGCCATCAATGATTCGCAAAGACATCCTTCACA
TAGATGTCGCCATCGTTCAGCTTTCAATGCCTGATGAGAATGGTTACTGTAGTTTTGGAGTATCTTGCGA
TTATAGCAAACCGGCAGCAGAAAGCGCTCATTTAGTTATAGGGGAAATCAACCGTCAAATGCCATATGT
ACATGGCGACAACTTGATTCACATATCGAAGTTGGATTACATCGTGATGGCAGACTACCCTATCTATTCT
CTTGCAAAGCCCAAAATCGGAGAAGTAGAAGAAGCTATCGGGCGTAATTGTGCCGAGCTTATTGAAGA
TGGTGCCACACTCCAACTCGGTATCGGCGCGATTCCTGATGCAGCCCTGTTATTCCTCAAGGACAAAAAA
GATCTGGGGATCCATACCGAGATGTTCTCCGATGGTGTTGTCGAATTAGTTCGCAGTGGAGTAATTACA
GGAAAGAAAAAGACACTTCACCCCGGAAAGATGGTCGCAACCTTCTTAATGGGAAGCGAAGACGTATA
TCATTTCATCGACAAAAATCCCGATGTAGAACTTTATCCGGTAGATTACGTCAATGATCCGCGAGTAATC
GCTCAAAATGATAATATGGTCAGCATCAATAGCTGTATCGAAATCGATCTTATGGGACAAGTCGTGTCC
GAATGTATAGGAAGCAAGCAATTCAGCGGAACCGGCGGTCAAGTAGATTATGTTCGTGGAGCAGCATG
GTCTAAAAACGGCAAAAGCATCATGGCAATTCCCTCAACAGCCAAAAACGGTACTGCATCTCGAATTGT
ACCTATAATTGCAGAGGGAGCTGCTGTAACAACCCTCCGCAACGAAGTCGATTACGTTGTAACCGAATA
CGGTATAGCACAACTCAAAGGAAAGAGTTTGCGCCAGCGAGCAGAAGCTCTTATTGCCATAGCCCACCC
GGATTTCAGAGAGGAACTAACGAAACATCTCCGCAAACGTTTCGGATAA

FIG. 20B

MKDVLAEYASRIVSAEEAVKHIKNGERVALSHAAGVPQSCVDALVQQADLFQNVEIYHMLCLGEGKYMAPE
MAPHFRHITNFVGGNSRKAVEENRADFIPVFFYEVPSMIRKDILHIDVAIVQLSMPDENGYCSFGVSCDYSKP
AAESAHLVIGEINRQMPYVHGDNLIHISKLDYIVMADYPIYSLAKPKIGEVEEAIGRNCAELIEDGATLQLGIGAI
PDAALLFLKDKKDLGIHTEMFSDGVVELVRSGVITGKKKTLHPGKMVATFLMGSEDVYHFIDKNPDVELYPV
DYVNDPRVIAQNDNMVSINSCIEIDLMGQVVSECIGSKQFSGTGGQVDYVRGAAWSKNGKSIMAIPSTAKN
GTASRIVPIIAEGAAVTTLRNEVDYVVTEYGIAQLKGKSLRQRAEALIAIAHPDFREELTKHLRKRFG

FIG. 21A
ATGATTAAGAGTTTTAATGAAATTATCATGAAGGTAAAGAGCAAAGAAATGAAAAAAGTTGCTGT
TGCTGTAGCACAAGACGAGCCAGTACTTGAAGCAGTAAGAGATGCTAAGAAAAATGGTATTGCAG
ATGCTATTCTTGTTGGAGACCATGACGAAATCGTGTCAATCGCGCTTAAAATAGGAATGGATGTA
AATGATTTTGAAATAGTAAACGAGCCTAACGTTAAGAAAGCTGCTTTAAAGGCAGTAGAGCTTGT
ATCAACTGGAAAAGCTGATATGGTAATGAAGGGACTTGTAAATACAGCAACTTTCTTAAGATCTG
TATTAAACAAAGAAGTTGGACTTAGAACAGGAAAAACTATGTCTCACGTTGCAGTATTTGAAACT
GAGAAATTTGATAGACTATTATTTTTAACAGATGTTGCTTTCAATACTTATCCTGAATTAAAGGA
AAAAATTGATATAGTAAACAATTCAGTTAAGGTTGCACATGCAATAGGAATTGAAAATCCAAAGG
TTGCTCCAATTTGTGCAGTTGAGGTTATAAACCCTAAAATGCCATCAACACTTGATGCAGCAATG
CTTTCAAAAATGAGTGACAGAGGACAAATTAAAGGTTGTGTAGTTGACGGACCTTTAGCACTTGA
TATAGCTTTATCAGAAGAAGCAGCACATCATAAGGGAGTAACAGGAGAAGTTGCTGGAAAAGCTG
ATATCTTCTTAATGCCAAACATAGAAACAGGAAATGTAATGTATAAGACTTTAACATATACAACT
GATTCAAAAAATGGAGGAATCTTAGTTGGAACTTCTGCACCAGTTGTTTTAACTTCAAGAGCTGA
CAGCCATGAAACAAAAATGAACTCTATAGCACTTGCAGCTTTAGTTGCAGGCAATAAATAA

FIG. 21B
MIKSFNEIIMKVKSKEMKKVAVAVAQDEPVLEAVRDAKKNGIADAILVGDHDEIVSIALKIGMDV
NDFEIVNEPNVKKAALKAVELVSTGKADMVMKGLVNTATFLRSVLNKEVGLRTGKTMSHVAVFET
EKFDRLLFLTDVAFNTYPELKEKIDIVNNSVKVAHAIGIENPKVAPICAVEVINPKMPSTLDAAM
LSKMSDRGQIKGCVVDGPLALDIALSEEAAHHKGVTGEVAGKADIFLMPNIETGNVMYKTLTYTT
DSKNGGILVGTSAPVVLTSRADSHETKMNSIALAALVAGNK

FIG. 22A

ATGTATAGATTACTAATAATCAATCCTGGCTCGACCTCAACTAAAATTGGTATTTATGACGATGA
AAAAGAGATATTTGAGAAGACTTTAAGACATTCAGCTGAAGAGATAGAAAAATATAACACTATAT
TTGATCAATTTCAATTCAGAAAGAATGTAATTTTAGATGCGTTAAAAGAAGCAAACATAGAAGTA
AGTTCTTTAAATGCTGTAGTTGGAAGAGGCGGACTCTTAAAGCCAATAGTAAGTGGAACTTATGC
AGTAAATCAAAAAATGCTTGAAGACCTTAAAGTAGGAGTTCAAGGTCAGCATGCGTCAAATCTTG
GTGGAATTATTGCAAATGAAATAGCAAAAGAAATAAATGTTCCAGCATACATAGTTGATCCAGTT
GTTGTGGATGAGCTTGATGAAGTTTCAAGAATATCAGGAATGGCTGACATTCCAAGAAAAGTAT
ATTCCATGCATTAAATCAAAAAGCAGTTGCTAGAAGATATGCAAAAGAAGTTGGAAAAAAATACG
AAGATCTTAATTTAATCGTAGTCCACATGGGTGGAGGTACTTCAGTAGGTACTCATAAAGATGGT
AGAGTAATAGAAGTTAATAATACACTTGATGGAGAAGGTCCATTCTCACCAGAAAGAAGTGGTGG
AGTTCCAATAGGAGATCTTGTAAGATTGTGCTTCAGCAACAAATATACTTATGAAGAAGTAATGA
AAAAGATAAACGGCAAAGGCGGAGTTGTTAGTTACTTAAATACTATCGATTTTAAGGCTGTAGTT
GATAAAGCTCTTGAAGGAGATAAGAAATGTGCACTTATATATGAAGCTTTCACATTCCAGGTAGC
AAAAGAGATAGGAAAATGTTCAACCGTTTTAAAAGGAAATGTAGATGCAATAATCTTAACAGGCG
GAATTGCGTACAACGAGCATGTATGTAATGCCATAGAGGATAGAGTAAAATTCATAGCACCTGTA
GTTAGATATGGTGGAGAAGATGAACTTCTTGCACTTGCAGAAGGTGGACTTAGAGTTTTAAGAGG
AGAAGAAAAAGCTAAGGAATACAAATAA

FIG. 22B

MYRLLIINPGSTSTKIGIYDDEKEIFEKTLRHSAEEIEKYNTIFDQFQFRKNVILDALKEANIEV
SSLNAVVGRGGLLKPIVSGTYAVNQKMLEDLKVGVQGQHASNLGGIIANEIAKEINVPAYIVDPV
VVDELDEVSRISGMADIPRKSIFHALNQKAVARRYAKEVGKKYEDLNLIVVHMGGGTSVGTHKDG
RVIEVNNTLDGEGPFSPERSGGVPIGDLVRLCFSNKYTYEEVMKKINGKGGVVSYLNTIDFKAVV
DKALEGDKKCALIYEAFTFQVAKEIGKCSTVLKGNVDAIILTGGIAYNEHVCNAIEDRVKFIAPV
VRYGGEDELLALAEGGLRVLRGEEKAKEYK

FIG. 23A

ATGATTAAGAGTTTTAATGAAATTATCATGAAGGTAAAGAGCAAAGAAATGAAAAAAGTTGCTGT
TGCTGTAGCACAAGACGAGCCAGTACTTGAAGCAGTACGCGATGCTAAGAAAAATGGTATTGCAG
ATGCTATTCTTGTTGGCGACCATGACGAAATCGTGTCAATCGCGCTTAAAATAGGCATGGATGTA
AATGATTTTGAAATAGTAAACGAGCCTAACGTTAAGAAAGCTGCTTTAAAGGCAGTAGAGCTGGT
ATCAACTGGAAAAGCTGATATGGTAATGAAGGGACTTGTAAATACAGCAACTTTCTTACGCTCTG
TATTAAACAAAGAAGTTGGACTGAGAACAGGAAAAACTATGTCTCACGTTGCAGTATTTGAAACT
GAGAAATTTGATCGTCTGTTATTTTTAACAGATGTTGCTTTCAATACTTATCCTGAATTAAAGGA
AAAAATTGATATCGTAAACAATTCAGTTAAGGTTGCACATGCAATAGGTATTGAAAATCCAAAGG
TTGCTCCAATTTGTGCAGTTGAGGTATAAACCCTAAAATGCCATCAACACTTGATGCAGCAATG
CTTTCAAAAATGAGTGACAGAGGACAAATTAAAGGTTGTGTAGTTGACGGACCGTTAGCACTTGA
TATCGCTTTATCAGAAGAAGCAGCACATCATAAGGGCGTAACAGGAGAAGTTGCTGGAAAAGCTG
ATATCTTCTTAATGCCAAACATTGAAACAGGAAATGTAATGTATAAGACTTTAACATATACAACT
GATAGCAAAAATGGCGGAATCTTAGTTGGAACTTCTGCACCAGTTGTTTTAACTTCACGCGCTGA
CAGCCATGAAACAAAAATGAACTCTATTGCACTTGCAGCTTTAGTTGCAGGCAATAAATAA

FIG. 23B

ATGATTAAGAGTTTTAATGAAATTATCATGAAGGTAAAGAGCAAAGAAATGAAAAAAGTTGCTGT
TGCTGTAGCACAAGACGAGCCAGTACTTGAAGCAGTACGCGATGCTAAGAAAAATGGTATTGCCG
ATGCTATTCTGGTTGGCGACCATGACGAAATCGTGTCTATCGCGCTGAAAATAGGCATGGATGTA
AATGATTTTGAAATTGTTAACGAGCCTAACGTTAAGAAAGCTGCGTTAAAGGCAGTAGAGCTGGT
ATCAACTGGAAAAGCTGATATGGTAATGAAGGGACTGGTAAATACCGCAACTTTCTTACGCTCTG
TATTAAACAAAGAAGTTGGTCTGCGTACAGGAAAAACCATGTCTCACGTTGCAGTATTTGAAACT
GAGAAATTTGATCGTCTGTTATTTTTAACAGATGTTGCTTTCAATACTTATCCTGAATTAAAGGA
AAAAATTGATATCGTTAACAATAGCGTTAAGGTTGCACATGCCATTGGTATTGAAAATCCAAAGG
TTGCTCCAATTTGTGCAGTTGAGGTTATTAACCCGAAAATGCCATCAACACTTGATGCAGCAATG
CTTTCAAAAATGAGTGACCGCGGACAAATTAAAGGTTGTGTAGTTGACGGACCGCTGGCACTTGA
TATCGCTTTATCAGAAGAAGCAGCACATCATAAGGGCGTAACAGGAGAAGTTGCTGGAAAAGCTG
ATATCTTCTTAATGCCAAACATTGAAACAGGAAATGTAATGTATAAGACGTTAACCTATACCACT
GATAGCAAAAATGGCGGCATCCTGGTTGGAACTTCTGCACCAGTTGTTTTAACTTCACGCGCTGA
CAGCCATGAAACAAAAATGAACTCTATTGCACTGGCAGCGCTGGTTGCAGGCAATAAATAA

FIG. 23C
ATGATTAAGAGTTTTAATGAAATTATCATGAAGGTAAAGAGCAAAGAAATGAAAAAAGTTGCTGT
TGCTGTTGCACAAGACGAGCCGGTACTGGAAGCGGTACGCGATGCTAAGAAAAATGGTATTGCCG
ATGCTATTCTGGTTGGCGACCATGACGAAATCGTCTCTATCGCGCTGAAAATTGGCATGGATGTT
AATGATTTTGAAATTGTTAACGAGCCTAACGTTAAGAAAGCTGCGCTGAAGGCGGTAGAGCTGGT
TTCCACCGGAAAAGCTGATATGGTAATGAAAGGGCTGGTGAATACCGCAACTTTCTTACGCAGCG
TACTGAACAAAGAAGTTGGTCTGCGTACCGGAAAAACCATGAGTCACGTTGCGGTATTTGAAACT
GAGAAATTTGATCGTCTGCTGTTTCTGACCGATGTTGCTTTCAATACTTATCCTGAATTAAAAGA
AAAAATTGATATCGTTAACAATAGCGTTAAGGTTGCGCATGCCATTGGTATTGAAAATCCAAAGG
TTGCTCCAATTTGTGCAGTTGAGGTTATTAACCCGAAAATGCCATCAACACTTGATGCCGCAATG
CTTAGCAAAATGAGTGACCGCGGACAAATTAAAGGTTGTGTGGTTGACGGCCCGCTGGCACTGGA
TATCGCGTTAAGCGAAGAAGCGGCACATCATAAAGGCGTAACCGGCGAAGTTGCTGGAAAAGCTG
ATATCTTCCTGATGCCAAACATTGAAACAGGCAATGTAATGTATAAAACGTTAACCTATACCACT
GATAGCAAAAATGGCGGCATCCTGGTTGGAACTTCTGCACCAGTTGTTTTAACCTCACGCGCTGA
CAGCCATGAAACCAAAATGAACAGCATTGCACTGGCAGCGCTGGTTGCAGGCAATAAATAA

FIG. 23D
ATGATTAAAAGTTTTAACGAAATTATCATGAAAGTGAAAAGCAAAGAGATGAAAAAAGTGGCGGT
TGCGGTTGCGCAGGATGAACCGGTGCTGGAAGCGGTGCGCGATGCCAAAAAAAACGGTATTGCCG
ATGCCATTCTGGTGGGCGATCACGATGAAATTGTCTCTATTGCGCTGAAAATTGGCATGGATGTT
AACGATTTTGAAATTGTTAATGAACCGAACGTGAAAAAAGCGGCGCTGAAAGCGGTTGAACTGGT
TTCCACCGGTAAAGCCGATATGGTGATGAAAGGGCTGGTGAATACCGCAACCTTCCTGCGCAGCG
TGCTGAATAAAGAAGTGGGTCTGCGTACCGGTAAACCATGAGTCATGTTGCGGTGTTTGAAACC
GAAAAATTTGACCGTCTGCTGTTTCTGACCGATGTTGCGTTTAATACCTATCCGGAACTGAAAGA
GAAAATTGATATCGTTAATAACAGCGTGAAAGTGGCGCATGCCATTGGTATTGAAAACCCGAAAG
TGGCGCCGATTTGCGCGGTTGAAGTGATTAACCCGAAAATGCCGTCAACGCTGGATGCCGCGATG
CTCAGCAAAATGAGCGATCGCGGTCAAATCAAAGGCTGTGTGGTTGATGGCCCGCTGGCGCTGGA
TATCGCGCTTAGCGAAGAAGCGGCGCATCATAAAGGCGTGACCGGCGAAGTGGCCGGTAAAGCCG
ATATTTTCCTGATGCCGAATATTGAAACCGGCAACGTGATGTATAAAACGCTGACCTATACCACC
GACAGCAAAACGGCGGCATTCTGGTGGGTACCAGCGCGCCGGTGGTGCTGACCTCGCGCGCCGA
CAGCCATGAAACCAAAATGAACAGCATTGCGCTGGCGGCGCTGGTGGCCGGTAATAAATAA

FIG. 24A

ATGTATCGTTTACTGATTATCAATCCTGGCTCGACCTCAACTAAAATTGGTATTTATGACGATGA
AAAAGAGATATTTGAGAAGACTTTACGTCATTCAGCTGAAGAGATAGAAAAATATAACACTATAT
TTGATCAATTTCAGTTCAGAAAGAATGTAATTCTCGATGCGTTAAAAGAAGCAAACATTGAAGTA
AGTTCTTTAAATGCTGTAGTTGGACGCGGCGGACTGTTAAAGCCAATAGTAAGTGGAACTTATGC
AGTAAATCAAAAAATGCTTGAAGACCTTAAAGTAGGCGTTCAAGGTCAGCATGCGTCAAATCTTG
GTGGAATTATTGCAAATGAAATAGCAAAAGAAATAAATGTTCCAGCATACATCGTTGATCCAGTT
GTTGTGGATGAGCTTGATGAAGTTTCACGTATATCAGGAATGGCTGACATTCCACGTAAAAGTAT
ATTCCATGCATTAAATCAAAAAGCAGTTGCTAGACGCTATGCAAAAGAAGTTGGAAAAAAATACG
AAGATCTTAATTTAATCGTGGTCCACATGGGTGGCGGTACTTCAGTAGGTACTCATAAAGATGGT
AGAGTAATTGAAGTTAATAATACACTTGATGGAGAAGGTCCATTCTCACCAGAAAGAAGTGGTGG
CGTTCCAATAGGCGATCTTGTACGTTTGTGCTTCAGCAACAAATATACTTATGAAGAAGTAATGA
AAAAGATAAACGGCAAAGGCGGCGTTGTTAGTTACTTAAATACTATCGATTTTAAGGCTGTAGTT
GATAAAGCTCTTGAAGGCGATAAGAAATGTGCACTTATATATGAAGCTTTCACATTCCAGGTAGC
AAAAGAGATAGGAAAATGTTCAACCGTTTTAAAAGGAAATGTAGATGCAATAATCTTAACAGGCG
GAATTGCGTACAACGAGCATGTATGTAATGCCATAGAGGATAGAGTAAAATTCATTGCACCTGTA
GTTCGTTATGGTGGAGAAGATGAACTTCTTGCACTTGCAGAAGGTGGACTGCGCGTTTTACGCGG
AGAAGAAAAGCTAAGGAATACAAATAA

FIG. 24B

ATGTATCGTTTACTGATTATCAATCCTGGCTCGACCTCAACTAAAATTGGTATTTATGACGATGA
AAAAGAGATATTTGAGAAGACGTTACGTCATTCAGCTGAAGAGATTGAAAAATATAACACTATAT
TTGATCAATTTCAGTTCCGCAAGAATGTGATTCTCGATGCGTTAAAAGAAGCAAACATTGAAGTC
AGTTCTTTAAATGCTGTAGTTGGACGCGGCGGACTGTTAAAGCCAATTGTCAGTGGAACTTATGC
AGTAAATCAAAAAATGCTTGAAGACCTTAAAGTGGGCGTTCAAGGTCAGCATGCCAGCAATCTTG
GTGGCATTATTGCCAATGAAATCGCAAAAGAAATCAATGTTCCAGCATACATCGTTGATCCGGTT
GTTGTGGATGAGCTTGATGAAGTTAGCCGTATAAGCGGAATGGCTGACATTCCACGTAAAAGTAT
ATTCCATGCATTAAATCAAAAAGCAGTTGCTCGTCGCTATGCAAAAGAAGTTGGTAAAAAATACG
AAGATCTTAATTTAATCGTGGTCCACATGGGTGGCGGTACTTCAGTAGGTACTCATAAAGATGGT
CGCGTGATTGAAGTTAATAATACACTTGATGGCGAAGGTCCATTCTCACCAGAACGTAGTGGTGG
CGTTCCAATTGGCGATCTGGTACGTTTGTGCTTCAGCAACAAATATACTTATGAAGAAGTGATGA
AAAAGATAAACGGCAAAGGCGGCGTTGTTAGTTACCTGAATACTATCGATTTTAAGGCTGTAGTT
GATAAAGCGCTTGAAGGCGATAAGAAATGTGCACTGATTTATGAAGCTTTCACCTTCCAGGTAGC
AAAAGAGATTGGTAAATGTTCAACCGTTTTAAAAGGAAATGTTGATGCCATTATCTTAACAGGCG
GCATTGCTTACAACGAGCATGTATGTAATGCCATTGAGGATCGCGTAAAATTCATTGCACCTGTA
GTTCGTTATGGTGGCGAAGATGAACTGCTGGCACTGGCAGAAGGTGGACTGCGCGTTTTACGCGG
CGAAGAAAAGCGAAGGAATACAAATAA

FIG. 24C

ATGTATCGTCTGCTGATTATCAATCCTGGCTCGACCTCAACTAAAATTGGTATTTATGACGATGA
AAAAGAGATATTTGAGAAAACGTTACGTCATAGCGCTGAAGAGATTGAAAAATATAACACTATTT
TTGATCAATTTCAGTTCCGCAAGAATGTGATTCTCGATGCGCTGAAAGAAGCAAACATTGAAGTC
AGTTCGCTGAATGCGGTAGTTGGTCGCGGCGGTCTGCTGAAGCCAATTGTCAGCGGCACTTATGC
GGTAAATCAAAAAATGCTGGAAGACCTGAAAGTGGGCGTTCAGGGGCAGCATGCCAGCAATCTTG
GTGGCATTATTGCCAATGAAATCGCCAAAGAAATCAATGTTCCGGCATACATCGTTGATCCGGTT
GTTGTGGATGAGCTGGATGAAGTTAGCCGTATCAGCGGAATGGCTGACATTCCACGTAAAAGTAT
TTTCCATGCACTGAATCAAAAAGCGGTTGCGCGTCGCTATGCAAAAGAAGTTGGTAAAAAATACG
AAGATCTTAATCTGATCGTGGTGCATATGGGTGGCGGTACTAGCGTCGGTACTCATAAAGATGGT
CGCGTGATTGAAGTTAATAATACACTTGATGGCGAAGGTCCATTCTCACCAGAACGTAGCGGTGG
CGTTCCAATTGGCGATCTGGTACGTTTGTGCTTCAGCAACAAATATACCTATGAAGAAGTGATGA
AAAAGATAAACGGCAAAGGCGGCGTTGTTAGTTACCTGAATACTATCGATTTTAAGGCGGTAGTT
GATAAAGCGCTGGAAGGCGATAAGAAATGTGCACTGATTTATGAAGCGTTCACCTTCCAGGTGGC
AAAAGAGATTGGTAAATGTTCAACCGTTCTGAAAGGCAATGTTGATGCCATTATCCTGACCGGCG
GCATTGCTTACAACGAGCATGTTTGTAATGCCATTGAGGATCGCGTAAAATTCATTGCACCTGTG
GTTCGTTATGGTGGCGAAGATGAACTGCTGGCACTGGCAGAAGGTGGTCTGCGCGTTTTACGCGG
CGAAGAAAAAGCGAAAGAATACAAATAA

FIG. 24D

ATGTATCGTCTGCTGATTATCAACCCGGGCAGCACCTCAACCAAAATTGGTATTTACGACGATGA
AAAAGAGATTTTTGAAAAACGCTGCGTCACAGCGCAGAAGAGATTGAAAAATACAACACCATTT
TCGATCAGTTCCAGTTCCGCAAAAACGTGATTCTCGATGCGCTGAAAGAAGCCAATATTGAAGTC
TCCTCGCTGAATGCGGTGGTCGGTCGCGGCGGTCTGCTGAAACCGATTGTCAGCGGCACTTATGC
GGTTAATCAGAAAATGCTGGAAGATCTGAAAGTGGGCGTGCAGGGGCAGCATGCCAGCAATCTCG
GCGGCATTATCGCCAATGAAATCGCCAAAGAGATCAACGTGCCGGCTTATATCGTCGATCCGGTG
GTGGTTGATGAACTGGATGAAGTCAGCCGTATCAGCGGCATGGCGGATATTCCGCGTAAAAGCAT
TTTCCATGCGCTGAATCAGAAAGCGGTTGCGCGTCGCTATGCCAAAGAAGTGGGTAAAAAATATG
AAGATCTCAATCTGATTGTGGTGCATATGGGCGGCGGCACCAGCGTCGGTACGCATAAAGATGGT
CGCGTGATTGAAGTGAATAACACGCTGGATGGCGAAGGGCCGTTCTCGCCGGAACGTAGCGGCGG
CGTGCCGATTGGCGATCTGGTGCGTCTGTGTTTCAGCAATAAATACACCTACGAAGAAGTGATGA
AAAAAATCAACGGCAAAGGCGGCGTGGTTAGCTATCTGAATACCATCGATTTAAAGCGGTGGTT
GATAAAGCGCTGGAAGGCGATAAAAATGCGCGCTGATTTATGAAGCGTTTACCTTCCAGGTGGC
GAAAGAGATTGGTAAATGTTCAACCGTGCTGAAAGGCAACGTTGATGCCATTATTCTGACCGGCG
GCATTGCTTATAACGAACATGTTTGTAATGCCATTGAAGATCGCGTGAAATTTATTGCGCCGGTG
GTGCGTTACGGCGGCGAAGATGAACTGCTGGCGCTGGCGGAAGGCGGTCTGCGCGTGCTGCGCGG
CGAAGAAAAAGCGAAAGAGTACAAATAA

FIG. 27A

ATGAATAAAGACACACTAATACCTACAACTAAAGATTTAAAAGTAAAAACAAATGGTGAAAACAT
TAATTTAAAGAACTACAAGGATAATTCTTCATGTTTCGGAGTATTCGAAAATGTTGAAAATGCTA
TAAGCAGCGCTGTACACGCACAAAAGATATTATCCCTTCATTATACAAAAGAGCAAAGAGAAAAA
ATCATAACTGAGATAAGAAAGGCCGCATTACAAAATAAAGAGGTCTTGGCTACAATGATTCTAGA
AGAAACACATATGGGAAGATATGAGGATAAAATATTAAAACATGAATTGGTAGCTAAATATACTC
CTGGTACAGAAGATTTAACTACTACTGCTTGGTCAGGTGATAATGGTCTTACAGTTGTAGAAATG
TCTCCATATGGTGTTATAGGTGCAATAACTCCTTCTACGAATCCAACTGAAACTGTAATATGTAA
TAGCATAGGCATGATAGCTGCTGGAAATGCTGTAGTATTTAACGGACACCCATGCGCTAAAAAAT
GTGTTGCCTTTGCTGTTGAAATGATAAATAAGGCAATTATTTCATGTGGCGGTCCTGAAAATCTA
GTAACAACTATAAAAAATCCAACTATGGAGTCTCTAGATGCAATTATTAAGCATCCTTCAATAAA
ACTTCTTTGCGGAACTGGGGGTCCAGGAATGGTAAAAACCCTCTTAAATTCTGGTAAGAAAGCTA
TAGGTGCTGGTGCTGGAAATCCACCAGTTATTGTAGATGATACTGCTGATATAGAAAAGGCTGGT
AGGAGCATCATTGAAGGCTGTTCTTTTGATAATAATTTACCTTGTATTGCAGAAAAAGAAGTATT
TGTTTTTGAGAATGTTGCAGATGATTTAATATCTAACATGCTAAAAAATAATGCTGTAATTATAA
ATGAAGATCAAGTATCAAAATTAATAGATTTAGTATTACAAAAAAATAATGAAACTCAAGAATAC
TTTATAAACAAAAAATGGGTAGGAAAAGATGCAAAATTATTCTTAGATGAAATAGATGTTGAGTC
TCCTTCAAATGTTAAATGCATAATCTGCGAAGTAAATGCAAATCATCCATTTGTTATGACAGAAC
TCATGATGCCAATATTGCCAATTGTAAGAGTTAAAGATATAGATGAAGCTATTAAATATGCAAAG
ATAGCAGAACAAAATAGAAAACATAGTGCCTATATTTATTCTAAAAATATAGACAACCTAAATAG
ATTTGAAAGAGAAATAGATACTACTATTTTTGTAAAGAATGCTAAATCTTTTGCTGGTGTTGGTT
ATGAAGCAGAAGGATTTACAACTTTCACTATTGCTGGATCTACTGGTGAGGGAATAACCTCTGCA
AGGAATTTTACAAGACAAAGAAGATGTGTACTTGCCGGCTAA

FIG. 27B

MNKDTLIPTTKDLKVKTNGENINLKNYKDNSSCFGVFENVENAISSAVHAQKILSLHYTKEQREK
IITEIRKAALQNKEVLATMILEETHMGRYEDKILKHELVAKYTPGTEDLTTTAWSGDNGLTVVEM
SPYGVIGAITPSTNPTETVICNSIGMIAAGNAVVFNGHPCAKKCVAFAVEMINKAIISCGGPENL
VTTIKNPTMESLDAIIKHPSIKLLCGTGGPGMVKTLLNSGKKAIGAGAGNPPVIVDDTADIEKAG
RSIIEGCSFDNNLPCIAEKEVFVFENVADDLISNMLKNNAVIINEDQVSKLIDLVLQKNNETQEY
FINKKWVGKDAKLFLDEIDVESPSNVKCIICEVNANHPFVMTELMMPILPIVRVKDIDEAIKYAK
IAEQNRKHSAYIYSKNIDNLRFEREIDTTIFVKNAKSFAGVGYEAEGFTTFTIAGSTGEGITSA
RNFTRQRRCVLAG

FIG. 28A

ATGAATAAAGACACACTAATACCTACAACTAAAGATTTAAAAGTAAAAACAAATGGTGAAAACAT
TAATTTAAAGAACTACAAGGATAATTCTTCATGTTTCGGCGTATTCGAAAATGTTGAAAATGCTA
TAAGCAGCGCTGTACACGCACAAAAGATATTATCCCTTCATTATACAAAAGAGCAACGTGAAAAA
ATCATAACTGAGATAAGAAAGGCCGCATTACAAAATAAAGAGGTCTTGGCTACAATGATTCTGGA
AGAAACACATATGGGACGTTATGAGGATAAAATATTAAAACATGAATTGGTAGCTAAATATACTC
CTGGTACAGAAGATTTAACTACTACTGCCTGGTCAGGTGATAATGGTCTGACAGTTGTAGAAATG
TCTCCATATGGTGTTATTGGTGCAATAACTCCTTCTACGAATCCAACTGAAACTGTAATATGTAA
TAGCATAGGCATGATTGCTGCTGGAAATGCTGTAGTATTTAACGGACACCCATGCGCTAAAAAAT
GTGTTGCCTTTGCTGTTGAAATGATAAATAAGGCAATTATTTCATGTGGCGGTCCTGAAAATCTG
GTAACAACTATAAAAAATCCAACCATGGAGTCTCTGGATGCAATTATTAAGCATCCTTCAATAAA
ACTTCTTTGCGGAACTGGGGGTCCAGGAATGGTAAAAACCCTGTTAAATTCTGGTAAGAAAGCTA
TAGGTGCTGGTGCTGGAAATCCACCAGTTATTGTCGATGATACTGCTGATATAGAAAGGCTGGT
CGTAGCATCATTGAAGGCTGTTCTTTTGATAATAATTTACCTTGTATTGCAGAAAAGAAGTATT
TGTTTTTGAGAATGTTGCAGATGATTTAATATCTAACATGCTAAAAATAATGCTGTAATTATAA
ATGAAGATCAAGTATCAAAATTAATCGATTTAGTATTACAAAAAAATAATGAAACTCAAGAATAC
TTTATAAACAAAAAATGGGTAGGAAAAGATGCAAAATTATTCCTCGATGAAATAGATGTTGAGTC
TCCTTCAAATGTTAAATGCATAATCTGCGAAGTAAATGCAAATCATCCATTTGTTATGACAGAAC
TGATGATGCCAATATTGCCAATTGTACGCGTTAAAGATATCGATGAAGCTATTAAATATGCAAAG
ATAGCAGAACAAAATAGAAAACATAGTGCCTATATTTATTCTAAAAATATCGACAACCTGAATCG
CTTTGAACGTGAAATAGATACTACTATTTTTGTAAAGAATGCTAAATCTTTTGCTGGTGTTGGTT
ATGAAGCAGAAGGATTTACAACTTTCACTATTGCTGGATCTACTGGTGAGGGAATAACCTCTGCA
CGTAATTTTACACGCCAACGTCGCTGTGTACTTGCCGGCTAA

FIG. 28B

ATGAATAAAGACACACTGATCCCTACAACTAAAGATTTAAAAGTAAAAACAAATGGTGAAAACAT
TAATTTAAAGAACTACAAAGATAATAGCAGTTGTTTCGGCGTATTCGAAAATGTTGAAAATGCTA
TCAGCAGCGCTGTACACGCACAAAAGATATTATCGCTGCATTATACAAAAGAGCAACGTGAAAAA
ATCATCACTGAGATACGTAAGGCCGCATTACAAAATAAAGAGGTGCTGGCTACAATGATTCTGGA
AGAAACACATATGGGACGTTATGAGGATAAAATATTAAAACATGAACTGGTAGCTAAATATACTC
CTGGTACAGAAGATTTAACTACTACTGCCTGGAGCGGTGATAATGGTCTGACAGTTGTAGAAATG
TCTCCATATGGTGTTATTGGTGCAATAACTCCTTCTACCAATCCAACTGAAACTGTAATTTGTAA
TAGCATTGGCATGATTGCTGCTGGAAATGCTGTAGTATTTAACGGACACCCATGCGCTAAAAAAT
GTGTTGCCTTTGCTGTTGAAATGATCAATAAGGCAATTATTAGCTGTGGCGGTCCGGAAAATCTG
GTAACAACTATAAAAAATCCAACCATGGAGTCTCTGGATGCCATTATTAAGCATCCTTCAATAAA
ACTGCTTTGCGGAACTGGCGGTCCAGGAATGGTAAAAACCCTGTTAAATTCTGGTAAGAAAGCTA
TTGGTGCTGGTGCTGGAAATCCACCAGTTATTGTCGATGATACTGCTGATATTGAAAGGCTGGT
CGTAGCATCATTGAAGGCTGTTCTTTTGATAATAATTTACCTTGTATTGCAGAAAAGAAGTATT
TGTTTTTGAGAATGTTGCAGATGATTTAATATCTAACATGCTGAAAAATAATGCTGTAATTATCA
ATGAAGATCAGGTATCAAAATTAATCGATTTAGTATTACAAAAAAATAATGAAACTCAAGAATAC
TTTATCAACAAAAAATGGGTAGGTAAAGATGCAAAATTATTCCTCGATGAAATCGATGTTGAGTC
TCCTTCAAATGTTAAATGCATTATCTGCGAAGTGAATGCCAATCATCC

FIG. 28B continued

ATTTGTTATGACAGAACTGATGATGCCAATATTGCCAATTGTGCGCGTTAAAGATATCGATGAAG
CTATTAAATATGCAAAGATTGCAGAACAAAATAGAAAACATAGTGCCTATATTTATAGCAAAAAT
ATCGACAACCTGAATCGCTTTGAACGTGAAATCGATACTACTATTTTTGTAAAGAATGCTAAATC
TTTTGCTGGTGTTGGTTATGAAGCAGAAGGATTTACCACTTTCACTATTGCTGGATCTACTGGTG
AGGGCATAACCTCTGCACGTAATTTTACCCGCCAACGTCGCTGTGTACTGGCCGGCTAA

FIG. 28C

ATGAATAAAGACACGCTGATCCCGACAACTAAAGATCTGAAAGTAAAAACCAATGGTGAAAACAT
TAATCTGAAGAACTACAAAGATAATAGCAGTTGTTTCGGCGTATTCGAAAATGTTGAAAATGCTA
TCAGCAGCGCGGTACACGCACAAAAGATACTCTCGCTGCATTATACCAAAGAGCAACGTGAAAAA
ATCATCACTGAGATCCGTAAGGCCGCATTACAAAATAAAGAGGTGCTGGCAACAATGATTCTGGA
AGAAACACATATGGGACGTTATGAGGATAAAATACTGAAACATGAACTGGTGGCGAAATATACGC
CTGGTACTGAAGATTTAACCACCACTGCCTGGAGCGGTGATAATGGTCTGACCGTTGTGGAAATG
TCGCCTTATGGTGTTATTGGTGCAATTACGCCTTCAACCAATCCAACTGAAACGGTAATTTGTAA
TAGCATTGGCATGATTGCTGCTGGAAATGCGGTAGTATTTAACGGTCACCCCTGCGCTAAAAAAT
GTGTTGCCTTTGCTGTTGAAATGATCAATAAAGCGATTATTAGCTGTGGCGGTCCGGAAAATCTG
GTAACCACTATAAAAAATCCAACCATGGAGTCGCTGGATGCCATTATTAAGCATCCTTCAATCAA
ACTGCTGTGCGGCACTGGCGGTCCAGGAATGGTGAAAACCCTGCTGAATAGCGGTAAGAAAGCGA
TTGGTGCTGGTGCTGGAAATCCACCAGTTATTGTCGATGATACTGCTGATATTGAAAAGCGGGT
CGTAGCATCATTGAAGGCTGTTCTTTTGATAATAATTTACCTTGTATTGCAGAAAAAGAAGTATT
TGTTTTTGAGAATGTTGCCGATGATCTGATCTCTAACATGCTGAAAAATAATGCGGTGATTATCA
ATGAAGATCAGGTTAGCAAACTGATCGATCTGGTATTACAAAAAAATAATGAAACTCAAGAATAC
TTTATCAACAAAAAATGGGTAGGTAAAGATGCAAAACTGTTCCTCGATGAAATCGATGTTGAGTC
GCCTTCAAATGTTAAATGCATTATCTGCGAAGTGAATGCCAATCATCCATTTGTGATGACCGAAC
TGATGATGCCAATTTTGCCGATTGTGCGCGTTAAAGATATCGATGAAGCGATTAAATATGCAAAG
ATTGCAGAACAAAATCGTAAACATAGTGCCTATATTTATAGCAAAAATATCGACAACCTGAATCG
CTTTGAACGTGAAATCGATACCACTATTTTTGTGAAGAATGCTAAATCTTTTGCTGGTGTTGGTT
ATGAAGCAGAAGGTTTTACCACTTTCACTATTGCTGGAAGCACCGGTGAAGGCATTACCTCTGCA
CGTAATTTTACCCGCCAACGTCGCTGTGTACTGGCCGGCTAA

FIG. 28D

ATGAATAAAGATACGCTGATCCCGACCACCAAAGATCTGAAAGTGAAAACCAACGGCGAAAATAT
CAACCTGAAAAACTATAAAGATAACAGCAGTTGCTTTGGCGTGTTTGAAAACGTTGAAAACGCCA
TCTCCAGCGCGGTGCATGCGCAAAAAATTCTCTCGCTGCATTACACCAAAGAGCAGCGTGAAAAA
ATTATCACCGAAATCCGTAAAGCGGCGCTGCAAAACAAGAAGTGCTGGCAACCATGATCCTGGA
AGAAACGCATATGGGGCGTTATGAAGATAAAATTCTGAAACATGAACTGGTGGCGAAATACACGC
CGGGCACTGAAGATCTGACCACCACCGCCTGGAGCGGCGATAACGGCCTGACCGTGGTGGAGATG
TCGCCTTATGGCGTGATTGGCGCGATTACGCCGTCAACCAACCCGACCGAAACGGTGATTTGTAA
CAGCATTGGCATGATTGCCGCGGGTAATGCGGTGGTGTTTAACGGTCATCCCTGCGCGAAAAAAT
GTGTGGCGTTTGCCGTTGAGATGATCAACAAAGCGATTATCAGCTGCGGCGGCCCGGAAAATCTG
GTGACCACCATCAAAAATCCGACCATGGAATCGCTGGATGCCATTATCAAACATCCTTCCATCAA
ACTGCTGTGCGGCACCGGCGGCCCGGGCATGGTGAAAACGCTGCTGAACAGCGGTAAAAAAGCGA
TTGGCGCGGGCGCGGGTAACCCGCCGGTGATTGTCGATGACACCGCCGATATT

FIG. 28D continued

```
GAAAAAGCGGGGCGTAGCATTATTGAAGGCTGTTCTTTTGATAACAACCTGCCCTGCATTGCCGA
AAAGAAGTGTTTGTCTTTGAAAACGTCGCCGATGATCTGATCAGCAATATGCTGAAAAACAACG
CGGTGATTATCAATGAAGATCAGGTTAGCAAACTGATCGATCTGGTGCTGCAAAAAAACAACGAA
ACGCAGGAATATTTTATCAACAAAAAATGGGTTGGTAAAGATGCCAAACTGTTTCTCGATGAAAT
CGATGTTGAATCGCCGTCTAACGTGAAATGTATTATCTGCGAAGTGAACGCCAACCATCCGTTTG
TGATGACCGAACTGATGATGCCGATTCTGCCGATTGTGCGCGTGAAAGATATCGATGAAGCGATT
AAATATGCCAAAATTGCCGAACAAAACCGTAAACACAGCGCCTATATTTACAGCAAAAATATCGA
TAACCTGAACCGCTTTGAACGTGAAATCGATACCACCATTTTTGTGAAAAATGCCAAAAGTTTTG
CCGGCGTTGGTTATGAAGCGGAAGGTTTTACCACCTTTACCATTGCCGGTAGCACCGGCGAAGGC
ATTACCAGCGCCCGTAATTTTACCCGCCAGCGTCGCTGCGTGCTGGCGGGCTAA
```

FIG. 31A

ATGAAAGCTGCAGTAGTAGAGCAATTTAAGGAACCATTAAAAATTAAAGAAGTGGAAAAGCCATC
TATTTCATATGGCGAAGTATTAGTCCGCATTAAAGCATGCGGTGTATGCCATACGGACTTGCACG
CCGCTCATGGCGATTGGCCAGTAAAACCAAAACTTCCTTTAATCCCTGGCCATGAAGGAGTCGGA
ATTGTTGAAGAAGTCGGTCCGGGGGTAACCCATTTAAAAGTGGGAGACCGCGTTGGAATTCCTTG
GTTATATTCTGCGTGCGGCCATTGCGAATATTGTTTAAGCGGACAAGAAGCATTATGTGAACATC
AACAAAACGCCGGCTACTCAGTCGACGGGGGTTATGCAGAATATTGCAGAGCTGCGCCAGATTAT
GTGGTGAAAATTCCTGACAACTTATCGTTTGAAGAAGCTGCTCCTATTTCTGCGCCGGAGTTAC
TACTTATAAAGCGTTAAAAGTCACAGGTACAAAACCGGGAGAATGGGTAGCGATCTATGGCATCG
GCGGCCTTGGACATGTTGCCGTCCAGTATGCGAAAGCGATGGGGCTTCATGTTGTTGCAGTGGAT
ATCGGCGATGAGAAACTGGAACTTGCAAAAGAGCTTGGCGCCGATCTTGTTGTAAATCCTGCAAA
AGAAAATGCGGCCCAATTTATGAAAGAGAAAGTCGGCGGAGTACACGCGGCTGTTGTGACAGCTG
TATCTAAACCTGCTTTTCAATCTGCGTACAATTCTATCCGCAGAGGCGGCACGTGCGTGCTTGTC
GGATTACCGCCGGAAGAAATGCCTATTCCAATCTTTGATACGGTATTAAACGGAATTAAAATTAT
CGGTTCCATTGTCGGCACGCGGAAAGACTTGCAAGAAGCGCTTCAGTTCGCTGCAGAAGGTAAAG
TAAAAACCATTATTGAAGTGCAACCTCTTGAAAAAATTAACGAAGTATTTGACAGAATGCTAAAA
GGAGAAATTAACGGACGGGTTGTTTTAACGTTAGAAAATAATAATTAA

FIG. 31B

MKAAVVEQFKEPLKIKEVEKPSISYGEVLVRIKACGVCHTDLHAAHGDWPVKPKLPLIPGHEGVG
IVEEVGPGVTHLKVGDRVGIPWLYSACGHCEYCLSGQEALCEHQQNAGYSVDGGYAEYCRAAPDY
VVKIPDNLSFEEAAPIFCAGVTTYKALKVTGTKPGEWVAIYGIGGLGHVAVQYAKAMGLHVVAVD
IGDEKLELAKELGADLVVNPAKENAAQFMKEKVGGVHAAVVTAVSKPAFQSAYNSIRRGGTCVLV
GLPPEEMPIPIFDTVLNGIKIIGSIVGTRKDLQEALQFAAEGKVKTIIEVQPLEKINEVFDRMLK
GEINGRVVLTLENNN aTGGCTATCGAAATCAAAGTACCGGACATCGGGGCTGATGAAGTTGAAATCACCGAGATCCTGGTCAAA
GTGGGCGACAAAGTTGAAGCCGAACAGTCGCTGATCACCGTAGAAGGCGACAAAGCCTCTATGGAAGT
TCCGTCTCCGCAGGCGGGTATCGTTAAAGAGATCAAAGTCTCTGTTGGCGATAAAACCCAGACCGGCGC
ACTGATTATGATTTTCGATTCCGCCGACGGTGCAGCAGACGCTGCACCTGCTCAGGCAGAAGAGAAGAA
AGAAGCAGCTCCGGCAGCAGCACCAGCGGCTGCGGCGGCAAAAGACGTTAACGTTCCGGATATCGGCA
GCGACGAAGTTGAAGTGACCGAAATCCTGGTGAAAGTTGGCGATAAAGTTGAAGCTGAACAGTCGCTG
ATCACCGTAGAAGGCGACAAGGCTTCTATGGAAGTTCCGGCTCCGTTTGCTGGCACCGTGAAAGAGATC
AAAGTGAACGTGGGTGACAAAGTGTCTACCGGCTCGCTGATTATGGTCTTCGAAGTCGCGGGTGAAGC
AGGCGCGGCAGCTCCGGCCGCTAAACAGGAAGCAGCTCCGGCAGCGGCCCCTGCACCAGCGGCTGGC
GTGAAAGAAGTTAACGTTCCGGATATCGGCGGTGACGAAGTTGAAGTGACTGAAGTGATGGTGAAAGT
GGGCGACAAAGTTGCCGCTGAACAGTCACTGATCACCGTAGAAGGCGACAAAGCTTCTATGGAAGTTCC
GGCGCCGTTTGCAGGCGTCGTGAAGGAACTGAAAGTCAACGTTGGCGATAAAGTGAAAACTGGCTCGC
TGATTATGATCTTCGAAGTTGAAGGCGCAGCGCCTGCGGCAGCTCCTGCGAAACAGGAAGCGGCAGCG
CCGGCACCGGCAGCAAAAGCTGAAGCCCCGGCAGCAGCACCAGCTGCGAAAGCGGAAGGCAAATCTG
AATTTGCTGAAAACGACGCTTATGTTCACGCGACTCCGCTGATCCGCCGTCTGGCACGCGAGTTTGGTGT
TAACCTTGCGAAAGTGAAGGGCACTGGCCGTAAAGGTCGTATCCTGCGCGAAGACGTTCAGGCTTACGT
GAAAGAAGCTATCAAACGTGCAGAAGCAGCTCCGGCAGCGACTGGCGGTGGTATCCCTGGCATGCTGC
CGTGGCCGAAGGTGGACTTCAGCAAGTTTGGTGAAATCGAAGAAGTGGAACTGGGCCGCATCCAGAAA
ATCTCTGGTGCGAACCTGAGCCGTAACTGGGTAATGATCCCGCATGTTACTCACTTCGACAAAACCGATA
TCACCGAGTTGGAAGCGTTCCGTAAACAGCAGAACGAAGAAGCGGCGAAACGTAAGCTGGATGTGAAG
ATCACCCCGGTTGTCTTCATCATGAAAGCCGTTGCTGCAGCTCTTGAGCAGATGCCTCGCTTCAATAGTTC
GCTGTCGGAAGACGGTCAGCGTCTGACCCTGAAGAAATACATCAACATCGGTGTGGCGGTGGATACCC
CGAACGGTCTGGTTGTTCCGGTATTCAAAGACGTCAACAAGAAAGGCATCATCGAGCTGTCTCGCGAGC
TGATGACTATTTCTAAGAAAGCGCGTGACGGTAAGCTGACTGCGGGCGAAATGCAGGGCGGTTGCTTC
ACCATCTCCAGCATCGGCGGCCTGGGTACTACCCACTTCGCGCCGATTGTGAACGCGCCGGAAGTGGCT
ATCCTCGGCGTTTCCAAGTCCGCGATGGAGCCGGTGTGGAATGGTAAAGAGTTCGTGCCGCGTCTGATG
CTGCCGATTTCTCTCTCCTTCGACCACCGCGTGATCGACGGTGCTGATGGTGCCCGTTTCATTACCATCAT
TAACAACACGCTGTCTGACATTCGCCGTCTGGTGATGTAAGTAAAAGAGCCGGCCCAACGGCCGGCTTT
TTTCTGGTAATCTCATGAATGTATTGAGGTTATTAGCGAATAGACAAATCGGTTGCCGTTTGTTGTTTAAA
AATTGTTAACAATTTTGTAAAATACCGACGGATAGAACGACCCGGTGGTGGTTAGGGTATTACTTCACAT
ACCCTATGGATTTCTGGGTGCAGCAAGGTAGCAAGCGCCAGAATCCCCAGGAGCTTACATAAGTAAGTG
ACTGGGGTGAGGGCGTGAAGCTAACGCCGCTGCGGCCTGAAAGACGACGGGTATGACCGCCGGAGAT
AAATATATAGAGGTC<u>ATGATGAGTACTGAAATCAAAACTCAGGTCGTGGTACTTGGGGCAGGCCCCGCA
GGTTACTCCGCTGCCTTCCGTTGCGCTGATTTAGGTCTGGAAACCGTAATCGTAGAACGTTACAACACCCC
TTGGCGGTGTTTGTCTGAACGTGGGTTGTATCCCTTCTAAAGCGCTGCTGCACGTGGCAAAAGTTATCGA
AGAAGCGAAAGCGCTGGCCGAACACGGCATCGTTTTCGGCGAACCGAAAACTGACATTGACAAGATCC
GCACCTGGAAAGAAAAAGTCATCACTCAGCTGACCGGTGGTCTGGCTGGCATGGCCAAAGGTCGTAAA
GTGAAGGTGGTTAACGGTCTGGGTAAATTTACCGGCGCTAACACCCTGGAAGTGGAAGGCGAAAACGG
CAAAACCGTGATCAACTTCGACAACGCCATCATCGCGGCGGGTTCCCGTCCGATTCAGCTGCCGTTTATC
CCGCATGAAGATCCGCGCGTATGGACTCCACCGACGCGCTGGAACTGAAATCTGTACCGAAACGCATG
CTGGTGATGGGCGGCGGTATCATCGGTCTGGAAATGGGTACCGTATACCATGCGCTGGGTTCAGAGATT
GACGTGGTGGAAATGTTCGACCAGGTTATCCCGGCTGCCGACAAAGACGTGGTGAAAGTCTTCACCAAA
CGCATCAGCAAGAAATTTAACCTGATGCTGGAAGCCAAAGTGACTGCCGTTGAAGCGAAAGAAGACGG</u>

FIG. 35

TATTTACGTTTCCATGGAAGGTAAAAAAGCACCGGCGGAAGCGCAGCGTTACGACGCAGTGCTGGTCG
CTATCGGCCGCGTACCGAATGGTAAAAACCTCGATGCAGGTAAAGCTGGCGTGGAAGTTGACGATCGC
GGCTTCATCCGCGTTGACAAACAAATGCGCACCAACGTGCCGCACATCTTTGCTATCGGCGATATCGTCG
GTCAGCCGATGCTGGCGCACAAAGGTGTCCATGAAGGCCACGTTGCCGCAGAAGTTATCTCCGGTCTGA
AACACTACTTCGATCCGAAAGTGATCCCATCCATCGCCTACACTAAACCAGAAGTGGCATGGGTCGGTCT
GACCGAGAAAGAAGCGAAAGAGAAAGGCATCAGCTACGAAACCGCCACCTTCCCGTGGGCTGCTTCCG
GCCGTGCTATCGCTTCTGACTGCGCAGATGGTATGACCAAACTGATCTTCGACAAAGAGACCCACCGTG
TTATCGGCGGCGCGATTGTCGGCACCAACGGCGGCGAGCTGCTGGGTGAGATCGGCCTGGCTATCGAG
ATGGGCTGTGACGCTGAAGACATCGCCCTGACCATCCACGCTCACCCGACTCTGCACGAGTCCGTTGGC
CTGGCGGCGGAAGTGTTCGAAGGCAGCATCACCGACCTGCCAAACGCCAAAGCGAAGAAAAAGTAACT
TTTTCTTTCAGGAAAAAAGCATAAGCGGCTCCGGGAGCCGCTTTTTTTATGCCTGATGTTTAGAACTATG
TCACTGTTCATAAACCGCTACACCTCATACATACTTTAAGGGCGAATTCTGCAGATATCCATCACACTGGC
GGCCGCTCGAGCATGCATCTAGCACATCCGGCAATTAAAAAAGCGGCTAACCACGCCGCTTTTTTTACGT
CTGCAATTTACCTTTCCAGTCTTCTTGCTCCACGTTCAGAGAGACGTTCGCATACTGCTGACCGTTGCTCG
TTATTCAGCCTGACAGTATGGTTACTGTCGTTTAGACGTTGTGGGCGGCTCTCCTGAACTTTCTCCCGAA
AAACCTGACGTTGTTCAGGTGATGCCGATTGAACACGCTGGCGGGCGTTATCACGTTGCTGTTGATTCA
GTGGGCGCTGCTGTACTTTTTCCTT

FIG. 35 continued

```
                                                                              Section 1
            (1)  1       ,10       ,20       ,30       ,40          52
    EC-IpdA (1)  MMSTEIKTQVVVLGAGPAGYSAAFRCADLGLETVIVERYNTLGGVCLNVGCI
KP-IpdA mutated (1)  MMSTEIKTQVVVLGAGPAGYSAAFRCADLGLETVIVERYSTLGGVCLNVGCI
                                                                              Section 2
            (53) 53     ,60        ,70       ,80       ,90        104
    EC-IpdA (53) PSKALLHVAKVIEEAKALAEHGIVFGEPKTDIDKIRTWKEKVINQLTGGLAG
KP-IpdA mutated (53) PSKALLHVAKVIEEAKALAEHGIVFGEPKTDIDKIRTWKEKVITQLTGGLAG
                                                                              Section 3
            (105) 105  ,110       ,120       ,130      ,140        156
    EC-IpdA (105) MAKGRKVKVVNGLGKFTGANTLEVEGENGKTVINFDNAIIAAGSRPIQLPFI
KP-IpdA mutated (105) MAKGRKVKVVNGLGKFTGANTLEVEGENGKTVINFDNAIIAAGSRPIQLPFI
                                                                              Section 4
            (157) 157       ,170      ,180       ,190             208
    EC-IpdA (157) PHEDPRIWDSTDALELKEVPEPLLVMGGGIIGLEMGTVYHALGSQIDVVEMF
KP-IpdA mutated (157) PHEDPRVWDSTDALELKSVPKRMLVMGGGIIGLEMGTVYHALGSEIDVVEMF
                                                                              Section 5
            (209) 209       ,220      ,230      ,240      ,250    260
    EC-IpdA (209) DQVIPAADKDIVKVFTKRISKKFNLMLETKVTAVEAKEDGIYVTMEGKKAPA
KP-IpdA mutated (209) DQVIPAADKDVVKVFTKRISKKFNLMLEAKVTAVEAKEDGIYVSMEGKKAPA
                                                                              Section 6
            (261) 261  ,270       ,280       ,290      ,300        312
    EC-IpdA (261) EPQRYDAVLVAIGRVPNGKNLDAGKAGVEVDDRGFIRVDKQLRTNVPHIFAI
KP-IpdA mutated (261) EAQRYDAVLVAIGRVPNGKNLDAGKAGVEVDDRGFIRVDKQMRTNVPHIFAI
                                                                              Section 7
            (313) 313       ,320      ,330      ,340      ,350    364
    EC-IpdA (313) GDIVGQPMLAHKGVHEGHVAAEVIAGKKHYFDPKVIPSIAYTEPEVAWVGLT
KP-IpdA mutated (313) GDIVGQPMLAHKGVHEGHVAAEVISGKKHYFDPKVIPSIAYTKPEVAWVGLT
                                                                              Section 8
            (365) 365  ,370       ,380       ,390      ,400        416
    EC-IpdA (365) EKEAKEKGISYETATFPWAASGRAIASDCADGMTKLIFDKESHRVIGGAIVG
KP-IpdA mutated (365) EKEAKEKGISYETATFPWAASGRAIASDCADGMTKLIFDKETHRVIGGAIVG
                                                                              Section 9
            (417) 417       ,430      ,440      ,450             468
    EC-IpdA (417) TNGGELLGEIGLAIEMGCDAEDIALTIHAHPTLHESVGLAAEVFEGSITDLP
KP-IpdA mutated (417) TNGGELLGEIGLAIEMGCDAEDIALTIHAHPTLHESVGLAAEVFEGSITDLP (469) 469  476
    EC-IpdA (469) NPKAKKK-
KP-IpdA mutated (469) NAKAKKK-
```

FIG. 36

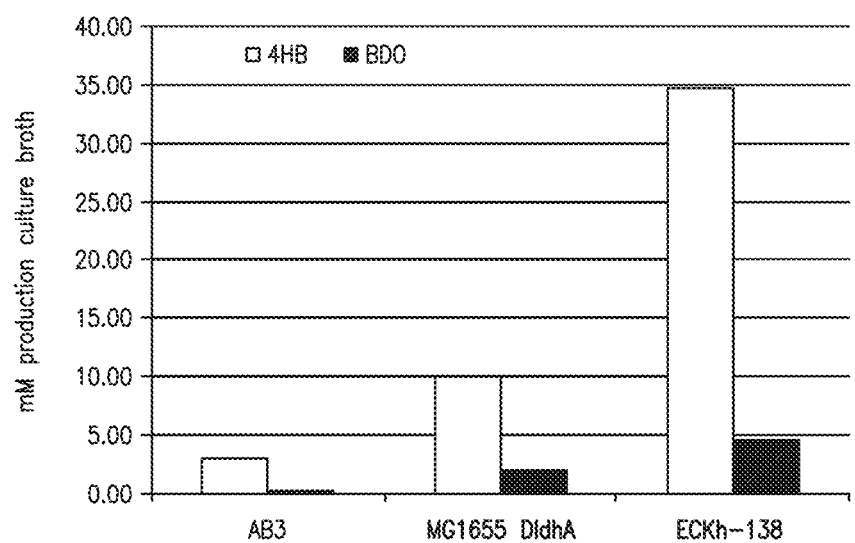

FIG. 37 atgataatacatatgaaccatgcgagttacgggcctataaagccaggcgagatatgatctatatcaatttctcatctataatgctttgtta
gtatctcgtcgccgacttaataaagagagagttagtgtgaaagctgacaaccctttgatcttttacttcctgctgcaatggccaaagtgg
ccgaagaggcgggtgtctataaagcaacgaaacatccgcttaagactttctatctggcgattaccgccggtgttttcatctcaatcgcattc
accactggcacaggcacaGAAGGTAGGTGTTACatgtcagaacgtttacacaatgacgtggatcctattattat

FIG. 38

```
AAGAGGTAAAAGAATAATGGCTATCGAAATCAAAGTACCGGACATCGGGGCTGATGAAGTTGAAATCA
CCGAGATCCTGGTCAAAGTGGGCGACAAAGTTGAAGCCGAACAGTCGCTGATCACCGTAGAAGGCGAC
AAAGCCTCTATGGAAGTTCCGTCTCCGCAGGCGGGTATCGTTAAAGAGATCAAAGTCTCTGTTGGCGAT
AAAACCCAGACCGGCGCACTGATTATGATTTTCGATTCCGCCGACGGTGCAGCAGACGCTGCACCTGCT
CAGGCAGAAGAGAAGAAAGAAGCAGCTCCGGCAGCAGCACCAGCGGCTGCGGCGGCAAAAGACGTTA
ACGTTCCGGATATCGGCAGCGACGAAGTTGAAGTGACCGAAATCCTGGTGAAAGTTGGCGATAAAGTT
GAAGCTGAACAGTCGCTGATCACCGTAGAAGGCGACAAGGCTTCTATGGAAGTTCCGGCTCCGTTTGCT
GGCACCGTGAAAGAGATCAAAGTGAACGTGGGTGACAAAGTGTCTACCGGCTCGCTGATTATGGTCTTC
GAAGTCGCGGGTGAAGCAGGCGCGGCAGCTCCGGCCGCTAAACAGGAAGCAGCTCCGGCAGCGGCCC
CTGCACCAGCGGCTGGCGTGAAAGAAGTTAACGTTCCGGATATCGGCGGTGACGAAGTTGAAGTGACT
GAAGTGATGGTGAAAGTGGGCGACAAAGTTGCCGCTGAACAGTCACTGATCACCGTAGAAGGCGACAA
AGCTTCTATGGAAGTTCCGGCGCCGTTTGCAGGCGTCGTGAAGGAACTGAAAGTCAACGTTGGCGATAA
AGTGAAAACTGGCTCGCTGATTATGATCTTCGAAGTTGAAGGCGCAGCGCCTGCGGCAGCTCCTGCGAA
ACAGGAAGCGGCAGCGCCGGCACCGGCAGCAAAAGCTGAAGCCCCGGCAGCAGCACCAGCTGCGAAA
GCGGAAGGCAAATCTGAATTTGCTGAAAACGACGCTTATGTTCACGCGACTCCGCTGATCCGCCGTCTG
GCACGCGAGTTTGGTGTTAACCTTGCGAAAGTGAAGGGCACTGGCCGTAAAGGTCGTATCCTGCGCGA
AGACGTTCAGGCTTACGTGAAAGAAGCTATCAAACGTGCAGAAGCAGCTCCGGCAGCGACTGGCGGTG
GTATCCCTGGCATGCTGCCGTGGCCGAAGGTGGACTTCAGCAAGTTTGGTGAAATCGAAGAAGTGGAA
CTGGGCCGCATCCAGAAAATCTCTGGTGCGAACCTGAGCCGTAACTGGGTAATGATCCCGCATGTTACT
CACTTCGACAAAACCGATATCACCGAGTTGGAAGCGTTCCGTAAACAGCAGAACGAAGAAGCGGCGAA
ACGTAAGCTGGATGTGAAGATCACCCCGGTTGTCTTCATCATGAAAGCCGTTGCTGCAGCTCTTGAGCA
GATGCCTCGCTTCAATAGTTCGCTGTCGGAAGACGGTCAGCGTCTGACCCTGAAGAAATACATCAACAT
CGGTGTGGCGGTGGATACCCCGAACGGTCTGGTTGTTCCGGTATTCAAAGACGTCAACAAGAAAGGCA
TCATCGAGCTGTCTCGCGAGCTGATGACTATTTCTAAGAAAGCGCGTGACGGTAAGCTGACTGCGGGCG
AAATGCAGGGCGGTTGCTTCACCATCTCCAGCATCGGCGGCCTGGGTACTACCCACTTCGCGCCGATTGT
GAACGCGCCGGAAGTGGCTATCCTCGGCGTTTCCAAGTCCGCGATGGAGCCGGTGTGGAATGGTAAAG
AGTTCGTGCCGCGTCTGATGCTGCCGATTTCTCTCTCCTTCGACCACCGCGTGATCGACGGTGCTGATGG
TGCCCGTTTCATTACCATCATTAACAACACGCTGTCTGACATTCGCCGTCTGGTGATGTAAGTAAAAGAG
CCGGCCCAACGGCCGGCTTTTTTCTGGTAATCTCATGAATGTATTGAGGTTATTAGCGAATAGACAAATC
GGTTGCCGTTTGTTAAGCCAGGCGAGATATGATCTATATCAATTTCTCATCTATAATGCTTTGTTAGTATC
TCGTCGCCGACTTAATAAAGAGAGAGTTAGTCTTCTATATCACAGCAAGAAGGTAGGTGTTACATGATG
AGTACTGAAATCAAAACTCAGGTCGTGGTACTTGGGGCAGGCCCCGCAGGTTACTCTGCAGCCTTCCGT
TGCGCTGATTTAGGTCTGGAAACCGTCATCGTAGAACGTTACAGCACCCTCGGTGGTGTTTGTCTGAACG
TGGGTTGTATCCCTTCTAAAGCGCTGCTGCACGTGGCAAAAGTTATCGAAGAAGCGAAAGCGCTGGCCG
AACACGGCATCGTTTTCGGCGAACCGAAAACTGACATTGACAAGATCCGCACCTGGAAAGAAAAAGTCA
TCACTCAGCTGACCGGTGGTCTGGCTGGCATGGCCAAAGGTCGTAAAGTGAAGGTGGTTAACGGTCTG
GGTAAATTTACCGGCGCTAACACCCTGGAAGTGGAAGGCGAAAACGGCAAACCGTGATCAACTTCGA
CAACGCCATCATCGCGGCGGGTTCCCGTCCGATTCAGCTGCCGTTTATCCCGCATGAAGATCCGCGCGTA
TGGGACTCCACCGACGCGCTGGAACTGAAATCTGTACCGAAACGCATGCTGGTGATGGGCGGCGGTAT
CATCGGTCTGGAAATGGGTACCGTATACCATGCGCTGGGTTCAGAGATTGACGTGGTGGAAATGTTCGA
CCAGGTTATCCCGGCTGCCGACAAAGACGTGGTGAAAGTCTTCACCAAACGCATCAGCAAGAAATTTAA
CCTGATGCTGGAAGCCAAAGTGACTGCCGTTGAAGCGAAAGAAGACGGTATTTACGTTTCCATGGAAG
GTAAAAAGCACCGGCGGAAGCGCAGCGTTACGACGCAGTGCTGGTCGCTATCGGCCGCGTACCGAAT
GGTAAAAACCTCGATGCAGGTAAAGCTGGCGTGGAAGTTGACGATCGCGGCTTCATCCGCGTTGACAA
```

FIG. 39

```
ACAAATGCGCACCAACGTGCCGCACATCTTTGCTATCGGCGATATCGTCGGTCAGCCGATGCTGGCGCA
CAAAGGTGTCCATGAAGGCCACGTTGCCGCAGAAGTTATCTCCGGTCTGAAACACTACTTCGATCCGAA
AGTGATCCCATCCATCGCCTACACTAAACCAGAAGTGGCATGGGTCGGTCTGACCGAGAAAGAAGCGA
AAGAGAAAGGCATCAGCTACGAAACCGCCACCTTCCCGTGGGCTGCTTCCGGCCGTGCTATCGCTTCTG
ACTGCGCAGATGGTATGACCAAACTGATCTTCGACAAAGAGACCCACCGTGTTATCGGCGGCGCGATTG
TCGGCACCAACGGCGGCGAGCTGCTGGGTGAGATCGGCCTGGCTATCGAGATGGGCTGTGACGCTGAA
GACATCGCCCTGACCATCCACGCTCACCCGACTCTGCACGAGTCCGTTGGCCTGGCGGCGGAAGTGTTC
GAAGGCAGCATCACCGACCTGCCAAACGCCAAAGCGAAGAAAAAGTAACTTTTTCTTTCAGGAAAAAAG
CATAAGCGGCTCCGGGAGCCGCTTTTTTTATGCCTGATGTTTAGAACTATGTCACTGTTCATAAACCGCTA
CACCTCATACATACTTTAAGGGCGAATTCTGCAGATATCCATCACACTGGCGGCCGCTCGAGCATGCATC
TAGCACATCCGGCAATTAAAAAAGCGGCTAACCACGCCGCTTTTTTTACGTCTGCAATTTACCTTTCCAGT
CTTCTTGCTCCACGTTCAGAGAGACGTTCGCATACTGCTGACCGTTGCTCGTTATTCAGCCTGACAGTAT
GGTTACTGTCGTTTAGACGTTGTGGGCGGCTCTCCTGAACTTTCTCCCGAAAAACCTGACGTTGTTCAGG
TGATGCCGATTGAACACGCTGGCGGGCGTTATCACGTTGCTGTTGATTCAGTGGGCGCTGCTGTACTTTT
TCCTTAAACACCTGGCGCTGCTCTGGTGATGCGGACTGAATACGCTCACGCGCTGCGTCTCTTCGCTGCT
GGTTCTGCGGGTTAGTCTGCATTTTCTCGCGAACCGCCTGGCGCTGCTCAGGCGAGGCGGACTGAATGC
GCTCACGCGCTGCCTCTCTTCGCTGCTGGATCTTCGGGTTAGTCTGCATTCTCGCGAACTGCCTGGCG
CTGCTCAGGCGAGGCGGACTGATAACGCTGACGAGCGGCGTCCTTTTGTTGCTGGGTCAGTGGTTGGC
GACGGCTGAAGTCGTGGAAGTCGTCATAGCTCCCATAGTGTTCAGCTTCATTAAACCGCTGTGCCGCTGC
CTGACGTTGGGTACCTCGTGTAATGACTGGTGCGGCGTGTGTTCGTTGCTGAAACTGATTTGCTGCCGCC
TGACGCTGGCTGTCGCGCGTTGGGGCAGGTAATTGCGTGGCGCTCATTCCGCCGTTGACATCGGTTTGA
TGAAACCGCTTTGCCATATCCTGATCATGATAGGGCACACCATTACGGTAGTTTGGATTGTGCCGCCATG
CCATATTCTTATCAGTAAGATGCTCACCGGTGATACGGTTGAAATTGTTGACGTCGATATTGATGTTGTC
GCCGTTGTGTTGCCAGCCATTACCGTCACGATGACCGCCATCGTGGTGATGATAATCAT
```

```
TTATTTGGTGATATTGGTACCAATATCATGCAGCAAACGGTGCAACATTGCCGTGTCTCGTTGCTCTAAA
AGCCCCAGGCGTTGTTGTAACCAGTCGACCAGTTTTATGTCATCTGCCACTGCCAGAGTCGTCAGCAATG
TCATGGCTCGTTCGCGTAAAGCTTGCAGTTGATGTTGGTCTGCCGTTGCATCACTTTTCGCCGGTTGTTGT
ATTAATGTTGCTAATTGATAGCAATAGACCATCACCGCCTGCCCCAGATTGAGCGAAGGATAATCCGCCA
CCATCGGCACACCAGTAAGAACGTCAGCCAACGCTAACTCTTCGTTAGTCAACCCGGAATCTTCGCGACC
AAACACCAGCGCGGCATGGCTCATCCATGAAGATTTTTCCTCTAACAGCGGCACCAGTTCAACTGGCGT
GGCGTAGTAATGATATTTCGCCCGACTGCGCGCAGTGGTGGCGACAGTGAAATCGACATCGTGTAACG
ATTCAGCCAATGTCGGGAAAACTTTAATATTATCAATAATATCACCAGATCCATGTGCGACCCAGCGGGT
GGCTGGCTCCAGGTGTGCCTGACTATCGACAATCCGCAGATCGCTAAACCCCATCGTTTTCATTGCCCGC
GCCGCTGCCCCAATATTTTCTGCTCTGGCGGGTGCGACCAGAATAATCGTTATACGCATATTGCCACTCTT
CTTGATCAAATAACCGCGAACCGGGTGATCACTGTCAACTTATTACGCGGTGCGAATTTACAAATTCTTA
ACGTAAGTCGCAGAAAAGCCCTTTACTTAGCTTAAAAAGGCTAAACTATTTCCTGACTGTACTAACGG
TTGAGTTGTTAAAAAATGCTACATATCCTTCTGTTTACTTAGGATAATTTTATAAAAATAAATCTCGACA
ATTGGATTCACCACGTTATTAGTTGTATGATGCAACTAGTTGGATTATTAAAATAATGTGACGAAAGCT
AGCATTTAGATACGATGATTTCATCAAACTGTTAACGTGCTACAATTGAACTTGATATATGTCAACGAAG
CGTAGTTTTATTGGGTGTCCGGCCCCTCTTAGCCTGTTATGTTGCTGTTAAAATGGTTAGGATGACAGCC
GTTTTTGACACTGTCGGGTCCTGAGGGAAAGTACCCACGACCAAGCTAATGATGTTGTTGACGTTGATG
GAAAGTGCATCAAGAACGCAATTACGTACTTTAGTCATGTTACGCCGATCATGTTAATTTGCAGCATGCA
TCAGGCAGGTCAGGGACTTTTGTACTTCCTGTTTCGATTTAGTTGGCAATTTAGGTAGCAAACGAATTCA
TCGGCTTTACCACCGTCAAAAAAACGGCGCTTTTTAGCGCCGTTTTTATTTTTCAACCTTATTTCCAGATA
CGTAACTCATCGTCCGTTGTAACTTCTTTACTGGCTTTCATTTTCGGCAGTGAAAACGCATACCAGTCGAT
ATTACGGGTCACAAACATCATGCCGGCCAGCGCCACCACCAGCACACTGGTTCCCAACAACAGCGCGCT
ATCGGCAGAGTTGAGCAGTCCCCACATCACACCATCCAGCAACAACAGCGCGAGGGTAAACAACATGCT
GTTGCACCAACCTTTCAATACCGCTTGCAAATAAATACCGTTCATTATCGCCCCAATCAGACTGGCGATTA
TCCATGCCACGGTAAAACCGGTATGTTCAGAAAGCGCCAGCAAGAGCAAATAAAACATCACCAATGAAA
GCCCCACCAGCAAATATTGCATTGGGTGTAAACGTTGCGCGGTGAGCGTTTCAAAAACAAAGAACGCCA
TAAAAGTCAGTGCAATCAGCAGAATGGCGTACTTAGTCGCCCGGTCAGTTAATTGGTATTGATCGGCTG
GCGTCGTTACTGCGACGCTAAACGCCGGGAAGTTTTCCCAGCCGGTATCATTGCCTGAAGCAAAACGCT
CACCGAGATTATTAGCAAACCAGCTGCTTTGCCAGTGCGCCTGAAAACCTGACTCGCTAACTTCCCGTTT
GGCTGGTAGAAAATCACCTAAAAAACTGGGATGCGGCCAGTTGCTGGTTAAGGTCATTTCGCTATTACG
CCCGCCAGGCACCACAGAAAGATCGCCGGTACCGCTTAAATTCAGGGCCATATTCAGCTTCAGGTTCTG
CTTCCGCCAGTCCCCTTCAGGTAAAGGGATATGCACGCCCTGCCCGCCTTGCTCTAACCCGGTGCCGGGT
TCAATGGTCAGCGCCGTTCCGTTAACTTCAGGCGCTTTCACCACACCAATACCACGCGCATCCCCGACGC
TAATCACAATAAATGGCTTGCCTAAGGTGATATTTGGCGCGTTGAGTTCGCTAAGACGCGAAACATCGA
AATCGGCTTTTAACGTTAAATCACTGTGCCAGACCTGACCGGTATAAATCCCTATCTTGCGTTCTTCCACG
TTCTGATTGCCATCAACCATCAATGACTCAGGTAACCAAAAATGGATAAACTTCGTTTCCGCTGCAGGG
TTTTAT
```

FIG. 42

```
AAGCCACAGCAGGATGCCCACTGCAACAAAGGTGATCACACCGGAAACGCGATGGAGAATGGACGCTA
TCGCCGTGATGGGGAACCGGATGGTCTGTAGGTCCAGATTAACAGGTCTTTGTTTTTTCACATTTCTTAT
CATGAATAACGCCCACATGCTGTTCTTATTATTCCCTGGGGACTACGGGCACAGAGGTTAACTTTCTGTT
ACCTGGAGACGTCGGGATTTCCTTCCTCCGGTCTGCTTGCGGGTCAGACAGCGTCCTTTCTATAACTGCG
CGTCATGCAAAACACTGCTTCCAGATGCGAAAACGACACGTTACAACGCTGGGTGGCTCGGGATTGCAG
GGTGTTCCGGAGACCTGGCGGCAGTATAGGCTGTTCACAAAATCATTACAATTAACCTACATATAGTTTG
TCGGGTTTTATCCTGAACAGTGATCCAGGTCACGATAACAACATTTATTTAATTTTTAATCATCTAATTTG
ACAATCATTCAACAAAGTTGTTACAAACATTACCAGGAAAAGCATATAATGCGTAAAAGTTATGAAGTC
GGTATTTCACCTAAGATTAACTTATGTAACAGTGTGGAAGTATTGACCAATTCATTCGGGACAGTTATTA
GTGGTAGACAAGTTTAATAATTCGGATTGCTAAGTACTTGATTCGCCATTTATTCGTCATCAATGGATCCT
TTACCTGCAAGCGCCCAGAGCTCTGTACCCAGGTTTTCCCCTCTTTCACAGAGCGGCGAGCCAAATAAAA
AACGGGTAAAGCCAGGTTGATGTGCGAAGGCAAATTTAAGTTCCGGCAGTCTTACGCAATAAGGCGCT
AAGGAGACCTTAAATGGCTGATACAAAAGCAAAACTCACCCTCAACGGGGATACAGCTGTTGAACTGGA
TGTGCTGAAAGGCACGCTGGGTCAAGATGTTATTGATATCCGTACTCTCGGTTCAAAAGGTGTGTTCACC
TTTGACCCAGGCTTCACTTCAACCGCATCCTGCGAATCTAAAATTACTTTTATTGATGGTGATGAAGGTAT
TTTGCTGCACCGCGGTTTCCCGATCGATCAGCTGGCGACCGATTCTAACTACCTGGAAGTTTGTTACATC
CTGCTGAATGGTGAAAAACCGACTCAGGAACAGTATGACGAATTTAAAACTACGGTGACCCGTCATACC
ATGATCCACGAGCAGATTACCCGTCTGTTCCATGCTTTCCGTCGCGACTCGCATCCAATGGCAGTCATGT
GTGGTATTACCGGCGCGCTGGCGGCGTTCTATCACGACTCGCTGGATGTTAACAATCCTCGTCACCGTGA
AATTGCCGCGTTCCTCCTGCTGTCGAAAATGCCGACCATGGCCGCGATGTGTTACAAGTATTCCATTGGT
CAGCCATTTGTTTACCCGCGCAACGATCTCTCCTACGCCGGTAACTTCCTGAATATGATGTTCTCCACGCC
GTGCGAACCGTATGAAGTTAATCCGATTCTGGAACGTGCTATGGACCGTATTCTGATCCTGCACGCTGAC
CATGAACAGAACGCCTCTACCTCCACCGTGCGTACCGCTGGCTCTTCGGGTGCGAACCCGTTTGCCTGTA
TCGCAGCAGGTATTGCTTCACTGTGGGGACCTGCGCACGGCGGTGCTAACGAAGCGGCGCTGAAAATG
CTGGAAGAAATCAGCTCCGTTAAACACATTCCGGAATTTGTTCGTCGTGCGAAAGACAAAAATGATTCTT
TCCGCCTGATGGGCTTCGGTCACCGCGTGTACAAAAATTACGACCCGCGCGCCACCGTAATGCGTGAAA
CCTGCCATGAAGTGCTGAAAGAGCTGGGCACGAAGGATGACCTGCTGGAAGTGGCTATGGAGCTGGAA
AACATCGCGCTGAACGACCCGTACTTTATCGAGAAGAAACTGTACCCGAACGTCGATTTCTACTCTGGTA
TCATCCTGAAAGCGATGGGTATTCCGTCTTCCATGTTCACCGTCATTTTCGCAATGGCACGTACCGTTGG
CTGGATCGCCCACTGGAGCGAAATGCACAGTGACGGTATGAAGATTGCCCGTCCGCGTCAGCTGTATAC
AGGATATGAAAAACGCGACTTTAAAGCGATATCAAGCGTTAATGGTTGATTGCTAAGTTGTAAATATTT
TAACCCGCCGTTCATATGGCGGGTTGATTTTTATATGCCTAAACACAAAAAATTGTAAAAATAAAATCCA
TTAACAGACCTATATAGATATTTAAAAAGAATAGAACAGCTCAAATTATCAGCAACCCAATACTTTCAATT
AAAAACTTCATGGTAGTCGCATTTATAACCCTATGAAAATGACGTCTATCTATACCCCCCTATATTTTATTC
ATCATACAACAAATTCATGATACCAATAATTTAGTTTTGCATTTAATAAAACTAACAATATTTTTAAGCAA
AACTAAAAACTAGCAATAATCAAATACGATATTCTGGCGTAGCTATACCCCTATTCTATATCCTTAAAGGA
CTCTGTTATGTTTAAAGGACAAAAAACATTGGCCGCACTGGCCGTATCTCTGCTGTTCACTGCACCTGTTT
ATGCTGCTGATGAAGGTTCTGGCGAAATTCACTTTAAGGGGAGGTTATTGAAGCACCTTGTGAAATTC
ATCCAGAAGATATTGATAAAAACATAGATCTTGGACAAGTCACGACAACCCATATAAACCGGGAGCATC
ATAGCAATAAAGTGGCCGTCGACATTCGCTTGATCAACTGTGATCTGCCTGCTTCTGACAACGGTAGCG
GAATGCCGGTATCCAAAGTTGGCGTAACCTTCGATAGCACGGCTAAGACAACTGGTGCTACGCCTTTGT
TGAGCAACACCAGTGCAGGCGAAGCAACTGGGGTCGGTGTACGACTGATGGACAAAAATGACGGTAAC
ATCGTATTAGGTTCAGCCGCGCCAGATCTTGACCTGGATGCAAGCTCATCAGAACAGACGCTGAACTTTT
TCGCCTGGAT
```

FIG. 43

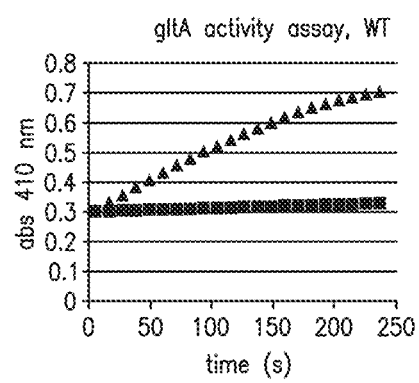
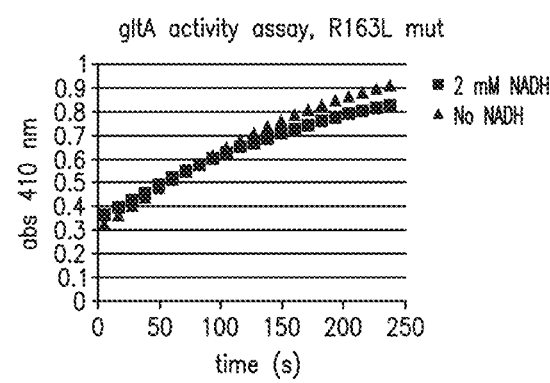
FIG. 44A  FIG. 44B
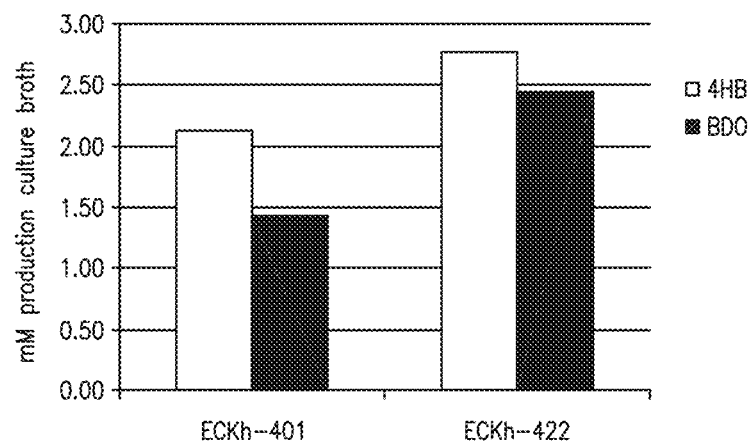
FIG. 45

CGCGATGTCGACGTCACGAAACTGAAAAAACCGCTCTACATTCTGGCGACTGCTGATGAAGAAACCAGT
ATGGCCGGAGCGCGTTATTTTGCCGAAACTACCGCCCTGCGCCCGGATTGCGCCATCATTGGCGAACCG
ACGTCACTACAACCGGTACGCGCACATAAAGGTCATATCTCTAACGCCATCCGTATTCAGGGCCAGTCG
GGGCACTCCAGCGATCCAGCACGCGGAGTTAACGCTATCGAACTAATGCACGACGCCATCGGGCATATT
TTGCAATTGCGCGATAACCTGAAAGAACGTTATCACTACGAAGCGTTTACCGTGCCATACCCTACGCTCA
ACCTCGGGCATATTCACGGTGGCGACGCTTCTAACCGTATTTGCGCTTGCTGTGAGTTGCATATGGATAT
TCGTCCGCTGCCTGGCATGACACTCAATGAACTTAATGGTTTGCTCAACGATGCATTGGCTCCGGTGAGC
GAACGCTGGCCGGGTCGTCTGACGGTCGACGAGCTGCATCCGCCGATCCCTGGCTATGAATGCCCACCG
AATCATCAACTGGTTGAAGTGGTTGAGAAATTGCTCGGAGCAAAAACCGAAGTGGTGAACTACTGTACC
GAAGCGCCGTTTATTCAAACGTTATGCCCGACGCTGGTGTTGGGGCCTGGCTCAATTAATCAGGCTCATC
AACCTGATGAATATCTGGAAACACGGTTTATCAAGCCCACCCGCGAACTGATAACCCAGGTAATTCACCA
TTTTTGCTGGCATTAAAACGTAGGCCGGATAAGGCGCTCGCGCCGCATCCGGCGCTGTTGCCAAACTCC
AGTGCCGCAATAATGTCGGATGCGATGCTTGCGCATCTTATCCGACCTACAGTGACTCAAACGATGCCCA
ACCGTAGGCCGGATAAGGCGCTCGCGCCGCATCCGGCACTGTTGCCAAACTCCAGTGCCGCAATAATGT
CGGATGCGATACTTGCGCATCTTATCCGACCGACAGTGACTCAAACGATGCCCAACTGTAGGCCGGATA
AGGCGCTCGCGCCGCATCCGGCACTGTTGCCAAACTCCAGTGCCGCAATAATGTCGGATGCGATACTTG
CGCATCTTATCCGACCTACACCTTTGGTGTTACTTGGGGCGATTTTTTAACATTTCCATAAGTTACGCTTAT
TTAAAGCGTCGTGAATTTAATGACGTAAATTCCTGCTATTTATTCGTTTGCTGAAGCGATTTCGCAGCATT
TGACGTCACCGCTTTTACGTGGCTTTATAAAGACGACGAAAAGCAAAGCCCGAGCATATTCGCGCCAA
TGCTAGCAAGAGGAGAAGTCGACATGACAGACTTAAATAAAGTGGTAAAAGAACTTGAAGCTCTTGGT
ATTTATGACGTAAAAGAAGTTGTTTACAATCCAAGCTACGAGCAATTGTTCGAAGAAGAAACTAAACCA
GGTTTAGAAGGCTTTGAAAAAGGTACTTTAACTACGACTGGTGCAGTGGCAGTAGATACAGGTATCTTC
ACAGGTCGTTCTCCAAAAGATAAATATATCGTGTTAGATGAAAAAACCAAAGATACTGTTTGGTGGACA
TCTGAAACAGCAAAAACGACAACAAGCCAATGAACCAAGCTACATGGCAAAGCTTAAAAGACTTGGTA
ACCAACCAGCTTTCTCGTAAACGCTTATTTGTAGTTGATGGTTTCTGTGGTGCGAGCGAACACGACCGTA
TTGCAGTACGTATTGTCACTGAAGTAGCGTGGCAAGCACATTTTGTAAAAAATATGTTTATTCGCCCAAC
TGAAGAACAACTCAAAAATTTTGAACCAGATTTCGTTGTAATGAATGGTTCTAAAGTAACCAATCCAAAC
TGGAAAGAACAAGGTTTAAATTCAGAAAACTTTGTTGCTTTCAACTTGACTGAACGCATTCAATTAATCG
GTGGTACTTGGTACGGCGGTGAAATGAAAAAAGGTATGTTCTCAATCATGAACTACTTCCTACCACTTAA
AGGTGTTGGTGCAATGCACTGCTCAGCTAACGTTGGTAAAGATGGCGATGTAGCAATCTTCTTCGGCTT
ATCTGGCACAGGTAAAACAACCCTTTCAACGGATCCAAAACGTGAATTAATCGGTGACGATGAACACGG
CTGGGATGATGTGGGTATCTTTAACTTTGAAGGTGGTTGCTATGCGAAAACCATTCACCTTTCAGAAGAA
AATGAACCAGATATTTACCGCGCTATCCGTCGCGACGCATTATTAGAAAACGTGGTTGTTCGTGCAGATG
GTTCTGTTGATTTCGATGATGGTTCAAAAACAGAAAATACTCGCGTGTCTTACCCAATTTATCACATTGAT
AACATTGTAAAACCAGTTTCTCGTGCAGGTCACGCAACTAAAGTGATTTTCTTAACTGCAGATGCATTTG
GCGTATTACCACCAGTATCTAAATTGACACCAGAACAAACTAAATACTACTTCTTATCTGGTTTCACAGCA
AAATTAGCAGGTACTGAACGTGGTATTACTGAACCAACTCCAACTTTCTCAGCATGTTTCGGTGCTGCGT
TCTTAACCCTTCACCCAACTCAATATGCAGAAGTGTTAGTAAAACGTATGCAAGCAGTGGGTGCTGAAG
CTTACTTAGTAAATACTGGTTGGAATGGCACAGGCAAACGTATCTCAATCAAAGATACTCGCGGAATCAT
TGATGCAATCTTAGATGGCTCAATTGAAAAGCTGAAATGGGCGAATTACCAATCTTTAACTTAGCCATT
CCTAAAGCATTACCAGGTGTAGATTCTGCAATCTTAGATCCTCGCGATACTTACGCAGATAAAGCACAAT
GGCAATCAAAGCTGAAGACTTAGCAGGTCGTTTTGTGAAAAACTTTGTTAAATATGCAACTAACGAAG
AAGGCAAAGCTTTAATTGCAGCTGGTCCTAAAGCTTAATCTAGAAAGCTTCCTAGAGGCATCAAATAAA
ACGAAAGGCTCAGTCGAAAGACTGGGCCTTTCGTTTTATCTGTTGTTTGTCGGTGAACGCTCTCCTGAGT

FIG. 48

```
AGGACGAATTCACTTCTGTTCTAACACCCTCGTTTTCAATATATTTCTGTCTGCATTTTATTCAAATTCTGA
ATATACCTTCAGATATCCTTAAGGAATTGTCGTTACATTCGGCGATATTTTTTCAAGACAGGTTCTTACTA
TGCATTCCACAGAAGTCCAGGCTAAACCTCTTTTTAGCTGGAAAGCCCTGGGTTGGGCACTGCTCTACTT
TTGGTTTTTCTCTACTCTGCTACAGGCCATTATTTACATCAGTGGTTATAGTGGCACTAACGGCATTCGCG
ACTCGCTGTTATTCAGTTCGCTGTGGTTGATCCCGGTATTCCTCTTTCCGAAGCGGATTAAAATTATTGCC
GCAGTAATCGGCGTGGTGCTATGGGCGGCCTCTCTGGCGGCGCTGTGCTACTACGTCATCTACGGTCAG
GAGTTCTCGCAGAGCGTTCTGTTTGTGATGTTCGAAACCAACACCAACGAAGCCAGCGAGTATTTAAGC
CAGTATTTCAGCCTGAAAATTGTGCTTATCGCGCTGGCCTATACGGCGGTGGCAGTTCTGCTGTGGACAC
GCCTGCGCCCGGTCTATATTCCAAAGCCGTGGCGTTATGTTGTCTCTTTTGCCCTGCTTTATGGCTTGATT
CTGCATCCGATCGCCATGAATACGTTTATCAAAAACAAGCCGTTTGAGAAAACGTTGGATAACCTGGCCT
CGCGTATGGAGCCTGCCGCACCGTGGCAATTCCTGACCGGCTATTATCAGTATCGTCAGCAACTAAACTC
GCTAACAAAGTTACTGAATGAAAATAATGCCTTGCCGCCACTGGCTAATTTCAAAGATGAATCGGGTAA
CGAACCGCGCACTTTAGTGCTGGTGATTGGCGAGTCGACCCAGCGCGGACGCATGAGTCTGTACGGTTA
TCCGCGTGAAACCACGCCGGAGCTGGATGCGCTGCATAAAACCGATCCGAATCTGACCGTGTTTAATAA
CGTAGTTACGTCTCGTCCGTACACCATTGAAATCCTGCAACAGGCGCTGACCTTTGCCAATGAAAAGAAC
CCGGATCTGTATCTGACGCAGCCGTCGCTGATGAACATGATGAAACAGGCGGGTTATAAAACCTTC
```

FIG. 48 (cont'd)

```
AATAGGCGTATCACGAGGCCCTTTCGTCTTCACCTCGAGAATTGTGAGCGGATAACAATTGACATTGTGA
GCGGATAACAAGATACTGAGCACATCAGCAGGACGCACTGACCGAATTCAATTAAGCTAGCAAGAGGA
GAAGTCGAGATGAACTTACATGAATATCAGGCAAAACAACTTTTTGCCCGCTATGGCTTACCAGCACCG
GTGGGTTATGCCTGTACTACTCCGCGCGAAGCAGAAGAAGCCGCTTCAAAAATCGGTGCCGGTCCGTGG
GTAGTGAAATGTCAGGTTCACGCTGGTGGCCGCGGTAAAGCGGGCGGTGTGAAAGTTGTAAACAGCAA
AGAAGACATCCGTGCTTTTGCAGAAAACTGGCTGGGCAAGCGTCTGGTAACGTATCAAACAGATGCCAA
TGGCCAACCGGTTAACCAGATTCTGGTTGAAGCAGCGACCGATATCGCTAAAGAGCTGTATCTCGGTGC
CGTTGTTGACCGTAGTTCCCGTCGTGTGGTCTTTATGGCCTCCACCGAAGGCGGCGTGGAAATCGAAAA
AGTGGCGGAAGAAACTCCGCACCTGATCCATAAAGTTGCGCTTGATCCGCTGACTGGCCCGATGCCGTA
TCAGGGACGCGAGCTGGCGTTCAAACTGGGTCTGGAAGGTAAACTGGTTCAGCAGTTCACCAAAATCTT
CATGGGCCTGGCGACCATTTTCCTGGAGCGCGACCTGGCGTTGATCGAAATCAACCCGCTGGTCATCAC
CAAACAGGGCGATCTGATTTGCCTCGACGGCAAACTGGGCGCTGACGGCAACGCACTGTTCCGCCAGCC
TGATCTGCGCGAAATGCGTGACCAGTCGCAGGAAGATCCGCGTGAAGCACAGGCTGCACAGTGGGAAC
TGAACTACGTTGCGCTGGACGGTAACATCGGTTGTATGGTTAACGGCGCAGGTCTGGCGATGGGTACG
ATGGACATCGTTAAACTGCACGGCGGCGAACCGGCTAACTTCCTTGACGTTGGCGGCGGCGCAACCAAA
GAACGTGTAACCGAAGCGTTCAAAATCATCCTCTCTGACGACAAAGTGAAAGCCGTTCTGGTTAACATCT
TCGGCGGTATCGTTCGTTGCGACCTGATCGCTGACGGTATCATCGGCGCGGTAGCAGAAGTGGGTGTTA
ACGTACCGGTCGTGGTACGTCTGGAAGGTAACAACGCCGAACTCGGCGCGAAGAAACTGGCTGACAGC
GGCCTGAATATTATTGCAGCAAAAGGTCTGACGGATGCAGCTCAGCAGGTTGTTGCCGCAGTGGAGGG
GAAATAATGTCCATTTTAATCGATAAAAACACCAAGGTTATCTGCCAGGGCTTTACCGGTAGCCAGGGG
ACTTTCCACTCAGAACAGGCCATTGCATACGGCACTAAAATGGTTGGCGGCGTAACCCCAGGTAAAGGC
GGCACCACCCACCTCGGCCTGCCGGTGTTCAACACCGTGCGTGAAGCCGTTGCTGCCACTGGCGCTACC
GCTTCTGTTATCTACGTACCAGCACCGTTCTGCAAAGACTCCATTCTGGAAGCCATCGACGCAGGCATCA
AACTGATTATCACCATCACTGAAGGCATCCCGACGCTGGATATGCTGACCGTGAAAGTGAAGCTGGATG
AAGCAGGCGTTCGTATGATCGGCCCGAACTGCCCAGGCGTTATCACTCCGGGTGAATGCAAAATCGGTA
TCCAGCCTGGTCACATTCACAAACCGGGTAAAGTGGGTATCGTTTCCCGTTCCGGTACACTGACCTATGA
AGCGGTTAAACAGACCACGGATTACGGTTTCGGTCAGTCGACCTGTGTCGGTATCGGCGGTGACCCGAT
CCCCGGGCTCTAACTTTATCGACATTCTCGAAATGTTCGAAAAAGATCCGCAGACCGAAGCGATCGTGAT
GATCGGTGAGATCGGCGGTAGCGCTGAAGAAGAAGCAGCTGCGTACATCAAAGAGCACGTTACCAAGC
CAGTTGTGGGTTACATCGCTGGTGTGACTGCGCCGAAAGGCAAACGTATGGGCCACGCGGGTGCCATC
ATTGCCGGTGGGAAAGGGACTGCGGATGAGAAATTCGCTGCTCTGGAAGCCGCAGGCGTGAAAACCGT
TCGCAGCCTGGCGGATATCGGTGAAGCACTGAAAACTGTTCTGAAATAATCTAGCAAGAGGAGAAGTC
GACATGGAAATCAAAGAAATGGTGAGCCTTGCACGCAAGGCTCAGAAGGAGTATCAAGCTACCCATAA
CCAAGAAGCAGTTGACAACATTTGCCGAGCTGCAGCAAAAGTTATTTATGAAAATGCAGCTATTCTGGC
TCGCGAAGCAGTAGACGAAACCGGCATGGGCGTTTACGAACACAAAGTGGCCAAGAATCAAGGCAAAT
CCAAAGGTGTTTGGTACAACCTCCACAATAAAAAATCGATTGGTATCCTCAATATAGACGAGCGTACCG
GTATGATCGAGATTGCAAAGCCTATCGGAGTTGTAGGAGCCGTAACGCCGACGACCAACCCGATCGTTA
CTCCGATGAGCAATATCATCTTTGCTCTTAAGACCTGCAATGCCATCATTATTGCCCCCCACCCCAGATCC
AAAAAATGCTCTGCACACGCAGTTCGTCTGATCAAAGAAGCTATCGCTCCGTTCAACGTACCGGAAGGT
ATGGTTCAGATCATCGAAGAACCCAGCATCGAGAAGACGCAGGAACTCATGGGCGCCGTAGACGTAGT
AGTTGCTACGGGTGGTATGGGCATGGTGAAGTCTGCATATTCTTCAGGAAAGCCTTCTTTCGGTGTTGG
AGCCGGTAACGTTCAGGTGATCGTGGATAGCAACATCGATTTCGAAGCTGCTGCAGAAAAAATCATCAC
```

FIG. 52

```
CGGTCGTGCTTTCGACAACGGTATCATCTGCTCAGGCGAACAGAGCATCATCTACAACGAGGCTGACAA
GGAAGCAGTTTTCACAGCATTCCGCAACCACGGTGCATATTTCTGTGACGAAGCCGAAGGAGATCGGGC
TCGTGCAGCTATCTTCGAAAATGGAGCCATCGCGAAAGATGTAGTAGGTCAGAGCGTTGCCTTCATTGC
CAAGAAAGCAAACATCAATATCCCCGAGGGTACCCGTATTCTCGTTGTTGAAGCTCGCGGCGTAGGAGC
AGAAGACGTTATCTGTAAGGAAAAGATGTGTCCCGTAATGTGCGCCCTCAGCTACAAGCACTTCGAAGA
AGGTGTAGAAATCGCACGTACGAACCTCGCCAACGAAGGTAACGGCCACACCTGTGCTATCCACTCCAA
CAATCAGGCACACATCATCCTCGCAGGATCAGAGCTGACGGTATCTCGTATCGTAGTGAATGCTCCGAG
TGCCACTACAGCAGGCGGTCACATCCAAAACGGTCTTGCCGTAACCAATACGCTCGGATGCGGATCATG
GGGTAATAACTCTATCTCCGAGAACTTCACTTACAAGCACCTCCTCAACATTTCACGCATCGCACCGTTGA
ATTCAAGCATTCACATCCCCGATGACAAAGAAATCTGGGAACTCTAATCTAGCAAGAGGAGAAGTCGAC
ATGCAACTTTTCAAACTCAAGAGTGTAACACATCACTTTGACACTTTTGCAGAATTTGCCAAGGAATTCTG
TCTTGGAGAACGCGACTTGGTAATTACCAACGAGTTCATCTATGAACCGTATATGAAGGCATGCCAGCTC
CCCTGCCATTTTGTTATGCAGGAGAAATATGGGCAAGGCGAGCCTTCTGACGAAATGATGAATAACATC
TTGGCAGACATCCGTAATATCCAGTTCGACCGCGTAATCGGTATCGGAGGAGGTACGGTTATTGACATC
TCTAAACTTTTCGTTCTGAAAGGATTAAATGATGTACTCGATGCATTCGACCGCAAAATACCTCTTATCAA
AGAGAAAGAACTGATCATTGTGCCCACAACATGCGGAACGGGTAGCGAGGTGACGAACATTTCTATCG
CAGAAATCAAAGCCGTCACACCAAAATGGGATTGGCTGACGATGCCATTGTTGCAGACCATGCCATCA
TCATACCTGAACTTCTGAAGAGCTTGCCTTTCCACTTCTACGCATGCAGTGCAATCGATGCTCTTATCCAT
GCCATCGAGTCATACGTATCTCCTAAAGCCAGTCCATATTCTCGTCTGTTCAGTGAGGCGGCTTGGGACA
TTATCCTGGAAGTATTCAAGAAAATCGCCGAACACGGCCCTGAATACCGCTTCGAAAAGCTGGGAGAAA
TGATCATGGCCAGCAACTATGCCGGTATAGCCTTCGGAAATGCAGGAGTAGGAGCCGTCCACGCACTAT
CCTACCCGTTGGGAGGCAACTATCACGTGCCGCATGGAGAAGCAAACTATCAGTTCTTCACAGAGGTAT
TCAAAGTATACCAAAAGAAGAATCCTTTCGGCTATATAGTCGAACTCAACTGGAAGCTCTCCAAGATACT
GAACTGCCAGCCCGAATACGTATATCCGAAGCTGGATGAACTTCTCGGATGCCTTCTTACCAAGAAACCT
TTGCACGAATACGGCATGAAGGACGAAGAGGTAAGAGGCTTTGCGGAATCAGTGCTTAAGACACAGCA
AAGATTGCTCGCCAACAACTACGTAGAGCTTACTGTAGATGAGATCGAAGGTATCTACAGAAGACTCTA
CTAATCTAGAAAGCTTCCTAGAGGCATCAAATAAAACGAAAGGCTCAGTCGAAAGACTGGGCCTTTCGT
TTTATCTGTTGTTTGTCGGTGAACGCTCTCCTGAGTAGGACAAATCCGCCGCCCTAGACCTAGGCGTTCG
GCTGCGACACGTCTTGAGCGATTGTGTAGGCTGGAGCTGCTTCGAAGTTCCTATACTTTCTAGAGAATAG
GAACTTCGGAATAGGAACTAAGGAGGATATTCATATGGACCATGGCTAATTCCCAT
```

FIG. 52 (cont'd)

TCGAGAAATTTATCAAAAGAGTGTTGACTTGTGAGCGGATAACAATGATACTTAGATTCAATTGTGAG
CGGATAACAATTTCACACAGAATTCAATTAAGCTAGCAAGAGGAGAAGTCGACATGGCCAACATAAGTT
CACCATTCGGGCAAAACGAATGGCTGGTTGAAGAGATGTACCGCAAGTTCCGCGACGACCCCTCCTCGG
TCGATCCCAGCTGGCACGAGTTCCTGGTTGACTACAGCCCCGAACCCACCTCCCAACCAGCTGCCGAACC
AACCCGGGTTACCTCGCCACTCGTTGCCGAGCGGGCCGCTGCGGCCGCCCCGCAGGCACCCCCCAAGCC
GGCCGACACCGCGGCCGCGGGCAACGGCGTGGTCGCCGCACTGGCCGCCAAAACTGCCGTTCCCCCGC
CAGCCGAAGGTGACGAGGTAGCGGTGCTGCGCGGCGCCGCCGCGGCCGTCGTCAAGAACATGTCCGC
GTCGTTGGAGGTGCCGACGGCGACCAGCGTCCGGGCGGTCCCGGCCAAGCTACTGATCGACAACCGGA
TCGTCATCAACAACCAGTTGAAGCGGACCCGCGGCGGCAAGATCTCGTTCACGCATTTGCTGGGCTACG
CCCTGGTGCAGGCGGTGAAGAAATTCCCGAACATGAACCGGCACTACACCGAAGTCGACGGCAAGCCC
ACCGCGGTCACGCCGGCGCACACCAATCTCGGCCTGGCGATCGACCTGCAAGGCAAGGACGGGAAGCG
TTCCCTGGTGGTGGCCGGCATCAAGCGGTGCGAGACCATGCGATTCGCGCAGTTCGTCACGGCCTACGA
AGACATCGTACGCCGGGCCCGCGACGGCAAGCTGACCACTGAAGACTTTGCCGGCGTGACGATTTCGCT
GACCAATCCCGGAACCATCGGCACCGTGCATTCGGTGCCGCGGCTGATGCCCGGCCAGGGCGCCATCAT
CGGCGTGGGCGCCATGGAATACCCCGCCGAGTTTCAAGGCGCCAGCGAGGAACGCATCGCCGAGCTGG
GCATCGGCAAATTGATCACTTTGACCTCCACCTACGACCACCGCATCATCCAGGGCGCGGAATCGGGCG
ACTTCCTGCGCACCATCCACGAGTTGCTGCTCTCGGATGGCTTCTGGGACGAGGTCTTCCGCGAACTGAG
CATCCCATATCTGCCGGTGCGCTGGAGCACCGACAACCCCGACTCGATCGTCGACAAGAACGCTCGCGT
CATGAACTTGATCGCGGCCTACCGCAACCGCGGCCATCTGATGGCCGATACCGACCCGCTGCGGTTGGA
CAAAGCTCGGTTCCGCAGTCACCCCGACCTCGAAGTGCTGACCCACGGCCTGACGCTGTGGGATCTCGA
TCGGGTGTTCAAGGTCGACGGCTTTGCCGGTGCGCAGTACAAGAAACTGCGCGACGTGCTGGGCTTGCT
GCGCGATGCCTACTGCCGCCACATCGGCGTGGAGTACGCCCATATCCTCGACCCCGAACAAAAGGAGTG
GCTCGAACAACGGGTCGAGACCAAGCACGTCAAACCCACTGTGGCCCAACAGAAATACATCCTCAGCAA
GCTCAACGCCGCCGAGGCCTTTGAAACGTTCCTACAGACCAAGTACGTCGGCCAGAAGCGGTTCTCGCT
GGAAGGCGCCGAAAGCGTGATCCCGATGATGGACGCGGCGATCGACCAGTGCGCTGAGCACGGCCTC
GACGAGGTGGTCATCGGGATGCCGCACCGGGCCGGCTCAACGTGCTGGCCAACATCGTCGGCAAGCC
GTACTCGCAGATCTTCACCGAGTTCGAGGGCAACCTGAATCCGTCGCAGGCGCACGGCTCCGGTGACGT
CAAGTACCACCTGGGCGCCACCGGGCTGTACCTGCAGATGTTCGGCGACAACGACATTCAGGTGTCGCT
GACCGCCAACCCGTCGCATCTGGAGGCCGTCGACCCGGTGCTGGAGGGATTGGTGCGGGCCAAGCAGG
ATCTGCTCGACCACGGAAGCATCGACAGCGACGGCCAACGGGCGTTCTCGGTGGTGCCGCTGATGTTGC
ATGGCGATGCCGCGTTCGCCGGTCAGGGTGTGGTCGCCGAGACGCTGAACCTGGCGAATCTGCCGGGC
TACCGCGTCGGCGGCACCATCCACATCATCGTCAACAACCAGATCGGCTTCACCACCGCGCCCGAGTATT
CCAGGTCCAGCGAGTACTGCACCGACGTCGCAAAGATGATCGGGGCACCGATCTTTCACGTCAACGGCG
ACGACCCGGAGGCGTGTGTCTGGGTGGCGCGGTTGGCGGTGGACTTCCGACAACGGTTCAAGAAGGAC
GTCGTCATCGACATGCTGTGCTACCGCCGCCGCGGGCACAACGAGGGTGACGACCCGTCGATGACCAA
CCCCTACATGTACGACGTCGTCGACACCAAGCGCGGGGCCCGCAAAAGCTACACCGAAGCCCTGATCGG
ACGTGGCGACATCTCGATGAAGGAGGCCGAGGACGCGCTGCGCGACTACCAGGGCCAGCTGGAACGG
GTGTTCAACGAAGTGCGCGAGCTGGAGAAGCACGGTGTGCAGCCGAGCGAGTCGGTCGAGTCCGACC
AGATGATTCCCGCGGGGCTGGCCACTGCGGTGGACAAGTCGCTGCTGGCCCGGATCGGCGATGCGTTC
CTCGCCTTGCCGAACGGCTTCACCGCGCACCCGCGAGTCCAACCGGTGCTGGAGAAGCGCCGGGAGAT
GGCCTATGAAGGCAAGATCGACTGGGCCTTTGGCGAGCTGCTGGCGCTGGGCTCGCTGGTGGCCGAAG
GCAAGCTGGTGCGCTTGTCGGGGCAGGACAGCCGCCGCGGCACCTTCTCCCAGCGGCATTCGGTTCTCA
TCGACCGCCACACTGGCGAGGAGTTCACACCACTGCAGCTGCTGGCGACCAACTCCGACGGCAGCCCGA
CCGGCGGAAAGTTCCTGGTCTACGACTCGCCACTGTCGGAGTACGCCGCCGTCGGCTTCGAGTACGGCT
ACACTGTGGGCAATCCGGACGCCGTGGTGCTCTGGGAGGCGCAGTTCGGCGACTTCGTCAACGGCGCA
```
```

FIG. 53

```
CAGTCGATCATCGACGAGTTCATCAGCTCCGGTGAGGCCAAGTGGGGCCAATTGTCCAACGTCGTGCTG
CTGTTACCGCACGGGCACGAGGGGCAGGGACCCGACCACACTTCTGCCCGGATCGAACGCTTCTTGCAG
TTGTGGGCGGAAGGTTCGATGACCATCGCGATGCCGTCGACTCCGTCGAACTACTTCCACCTGCTACGCC
GGCATGCCCTGGACGGCATCCAACGCCCGCTGATCGTGTTCACGCCCAAGTCGATGTTGCGTCACAAGG
CCGCCGTCAGCGAAATCAAGGACTTCACCGAGATCAAGTTCCGCTCAGTGCTGGAGGAACCCACCTATG
AGGACGGCATCGGAGACCGCAACAAGGTCAGCCGGATCCTGCTGACCAGTGGCAAGCTGTATTACGAG
CTGGCCGCCCGCAAGGCCAAGGACAACCGCAATGACCTCGCGATCGTGCGGCTTGAACAGCTCGCCCC
GCTGCCCAGGCGTCGACTGCGTGAAACGCTGGACCGCTACGAGAACGTCAAGGAGTTCTTCTGGGTCCA
AGAGGAACCGGCCAACCAGGGTGCGTGGCCGCGATTCGGGCTCGAACTACCCGAGCTGCTGCCTGACA
AGTTGGCCGGGATCAAGCGAATCTCGCGCCGGGCGATGTCAGCCCCGTCGTCAGGCTCGTCGAAGGTG
CACGCCGTCGAACAGCAGGAGATCCTCGACGAGGCGTTCGGCTAATCTAGCAAGAGGAGAAGTCGACA
TGAAGTTATTAAAATTGGCACCTGATGTTTATAAATTTGATACTGCAGAGGAGTTTATGAAATACTTTAA
GGTTGGAAAAGGTGACTTTATACTTACTAATGAATTTTTATATAAACCTTTCCTTGAGAAATTCAATGATG
GTGCAGATGCTGTATTTCAGGAGAAATATGGACTCGGTGAACCTTCTGATGAAATGATAAACAATATAA
TTAAGGATATTGGAGATAAACAATATAATAGAATTATTGCTGTAGGGGGAGGATCTGTAATAGATATAG
CCAAAATCCTCAGTCTTAAGTATACTGATGATTCATTGGATTTGTTTGAGGGAAAAGTACCTCTTGTAAA
AAACAAAGAATTAATTATAGTTCCAACTACATGTGGAACAGGTTCAGAAGTTACAAATGTATCAGTTGCA
GAATTAAAGAGAAGACATACTAAAAAAGGAATTGCTTCAGACGAATTATATGCAACTTATGCAGTACTT
GTACCAGAATTTATAAAAGGACTTCCATATAAGTTTTTTGTAACCAGCTCCGTAGATGCCTTAATACATGC
AACAGAAGCTTATGTATCTCCAAATGCAAATCCTTATACTGATATGTTTAGTGTAAAAGCTATGGAGTTA
ATTTTAAATGGATACATGCAAATGGTAGAGAAAGGAAATGATTACAGAGTTGAAATAATTGAGGATTTT
GTTATAGGCAGCAATTATGCAGGTATAGCTTTTGGAAATGCAGGAGTGGGAGCGGTTCACGCACTCTCA
TATCCAATAGGCGGAAATTATCATGTGCCTCATGGAGAAGCAAATTATCTGTTTTTTACAGAAATATTTA
AAACTTATTATGAGAAAAATCCAAATGGCAAGATTAAAGATGTAAATAAACTATTAGCAGGCATACTAA
AATGTGATGAAAGTGAAGCTTATGACAGTTTATCACAACTTTTAGATAAATTATTGTCAAGAAAACCATT
AAGAGAATATGGAATGAAAGAGGAAGAAATTGAAACTTTTGCTGATTCAGTAATAGAAGGACAGCAGA
GACTGTTGGTAAACAATTATGAACCTTTTTCAAGAGAAGACATAGTAAACACATATAAAAGTTATATTA
ATCTAGAAAGCTTCCTAGAGGCATCAAATAAAACGAAAGGCTCAGTCGAAAGACTGGGCCTTTCGTTTT
ATCTGTTGTTTGTCGGTGAACGCTCTCCTGAGTAGGACAAATCCGCCGCCCTAGACCTA
```

FIG. 53 (cont'd)

```
                                                          cscR w/5' del
                                                 >~~~~~~~~~~~~~~~~~~~~~~~~~~~~~~~~~~~~~~~~~~~~~~~~~~
              SENSE_PRM
     ~~~~~~~~~~~~~~~~~~~~~~~~~~~~~~~~~~~~~~~~~~~~~~~~~~~~~~~~~~~~~~~
  1   TCTGTATCAG GCTGAAAATC TTCTCTCATC CGCCAAAACA GCTTCGGCGT TAAGATGCGC GCTCAAGGAC GTAAGCCGTC GACTCTCGCC GTGCTGGCGC
      AGACATAGTC CGACTTTTAG AAGAGAGTAG GCGGTTTTGT CGAAGCCGCA ATTCTACGCG CGAGTTCCTG CATTCGGCAG CTGAGAGCGG CACGACCGCG
                                                          cscR w/5' del
                                           ~~~~~~~~~~~~~~~~~~~~~~~~~~~~~~~~~~~~~~~~~~~~~~~~~~~~~~~~~
 101  AGGACACGGC TACCACTCCT TTCTCTGTTG ATATTCTGCT TGCCATTGAG CAAACCGCCA GCGAGTTCGG CTGGAATAGT TTTTAATCA ATATTTTTTC
      TCCTGTGCCG ATGGTGAGGA AAGAGACAAC TATAAGACGA ACGGTAACTC GTTGGCGGT CGCTCAAGCC GACCTTATCA AAAAATTAGT TATAAAAAAG
                                                          cscR w/5' del
                                           ~~~~~~~~~~~~~~~~~~~~~~~~~~~~~~~~~~~~~~~~~~~~~~~~~~~~~~~~~
 201  TGAAGATGAC GCTGCCCGCG CGGCACGTCA GCTGCTTGCC CACCGTCCGG ATGGCATTAT CTATACTACA ATGGGGCTGC GACATATCAC GCTGCCTGAG
      ACTTCTACTG CGACGGGCGC GCCGTGCAGT CGACGAACGG GTGGCAGGCC TACCGTAATA GATATGATGT TACCCCGACG CTGTATAGTG CGACGGACTC
                                                          cscR w/5' del
                                           ~~~~~~~~~~~~~~~~~~~~~~~~~~~~~~~~~~~~~~~~~~~~~~~~~~~~~~~~~
 301  TCTCTGTATG GTGAAAATAT TGTATTGGCG AACTGTGTGG CGGATGACCC AGCGTTACCC AGTTATATCC CTGATGATTA CACTGCACAA TATGAATCAA
      AGAGACATAC CACTTTTATA ACATAACCGC TTGACACACC GCCTACTGGG TCGCAATGGG TCAATATAGG GACTACTAAT GTGACGTGTT ATACTTAGTT
                                                          cscR w/5' del
                                           ~~~~~~~~~~~~~~~~~~~~~~~~~~~~~~~~~~~~~~~~~~~~~~~~~~~~~~~~~
 401  CACAGCATTT GCTCGCGGCG GGCTATCGTC AACCGTTATG CTTCTGGCTA CCGGAAAGTG CGTTGGCAAC AGGGTATCGT CGGCAGGGAT TTCAGCAGGC
      GTGTCGTAAA CGAGCGCCGC CCGATAGCAG TTGGCAATAC GAAGACCGAT GGCCTTTCAC GCAACCGTTG TCCCATAGCA GCCGTCCCTA AACTCGTCCG
                                                          cscR w/5' del
                                           ~~~~~~~~~~~~~~~~~~~~~~~~~~~~~~~~~~~~~~~~~~~~~~~~~~~~~~~~~
 501  CTGGCCGTGAT GCTGGACGAG ATCGGCTGA GGTGAAACAA TTTCACATGG CAACAGGTGA TGATCACTAC ACCGATCTCG CAAGTTTACT CAATGCCCAC
      GACCGCACTA CGACCTGCTC TAGACCGACT CCACTTTGTT AAAGTGTACC GTTGTCCACT ACTAGTGATG TGGCTAGAGC GTTCAAATGA GTTACGGGTG
                                                          cscR w/5' del
                                           ~~~~~~~~~~~~~~~~~~~~~~~~~~~~~~~~~~~~~~~~~~~~~~~~~~~~~~~~~
 601  TTCAAACCGG GCAAACCAGA TTTTGATGTT CTGATATGTG GTAACGATCG CGCAGCCTTT GTGGCTTATC AGGTTCTTCT GGCGAAGGGG GTACGAATCC
      AAGTTTGGCC CGTTTGGTCT AAAACTACAA GACTATACAC CATTGCTAGC GCGTCGGAAA CACCGAATAG TCCAAGAAGA CCGCTTCCCC CATGCTTAGG
                                                          cscR w/5' del
                                           ~~~~~~~~~~~~~~~~~~~~~~~~~~~~~~~~~~~~~~~~~~~~~~~~~~~~~~~~~
 701  CGCAGGATGT CGCCGTAAGC GGCTTTGATA ATCTGGTTGG CGTCGGGCAT CTGTTTTTAC CGCCGCTGAC CACAATTCAG CTTCCACATG ACATTATCGG
      GCGTCCTACA GCGGCATTAC CCGAAACTAT TAGACCAACC GCAGCCCGTA GACAAAAATG GCGGCGACTG GTGTTAAGTC GAAGGTGTAC TGTAATAGCC
                                                          cscR w/5' del
                                           ~~~~~~~~~~~~~~~~~~~~~~~~~~~~~~~~~~~~~~~~~~~~~~~~~~~~~~~~
 801  GCGGGAAGCT GCATTGCATA TTATTGAAGG TCGTGAAGGG GGAAGAGTGA CGCGGATCCC TTGCCCGCTG TTGATCCGTT GTTCCACCTG ATATTATGTT
      CGCCCTTCGA CGTAACGTAT AATAACTTCC AGCACTTCCC CCTTCTCACT GCGCCTAGGG AACGGGCGAC AACTAGGCAA CAAGGTGGAC TATAATACAA
                                                                                                              cscA
 901  AACCCAGTAG CCAGAGTGCT CCATGTTGCA GCACAGCCAC TCCGTGGGAG GCATAAAGCC ACAGTTCCCG TTCTTCTGGC TGCGGATAGA TTCGACTACT
      TTGGGTCATC GGTCTCACGA GGTACAACGT CGTGTCGGTG AGGCACCCTC CGTATTCGC TGTCAAGGGC AAGAAGACCG ACGCCTATCT AAGCTGATGA
                                                           cscA
1001  CATCACCGCT TCCCCGTCGT TAATAAATAC TTCACGGAT GATGTATCGA TAAATATCCT TAGGGCGAGC GTGTCACGCT GTGGGAGGGG AATACTACGG
      GTAGTGGCGA AGGGGCAGCA ATTATTTATG AAGGTGCCTA CTACATAGCT ATTTATAGGA ATCCCGCTCG CACAGTGCGA CGCCCTCCCC TTATGATGCC
                                                           ~~~~~~~~~~~~~~~~~~~~~~~~~~~~~~~~~~~~~~~~~~~~~~~~~~
```

FIG. 55

```
                                        cscA
1101    TAGCCGTCTA AATTCTCGTG TGGGTAATAC CGCCACAAAA CAAGTCGCTC AGATTGGTTA TCAATATACA GCCGCATTCC AGTGCCGAGC TGTAATCCGT
        ATCGGCAGAT TTAAGAGCAC ACCCATTATG GCGGTGTTTT GTTCAGCCAG TCTAACCAAT AGTTATATGT CGGCGTAAGG TCACGGCTCG ACATTAGGCA cscA
1201    AATGTTCGGC ATCACTGTTC TTCAGCGCCC ACTGCAACTG AATCTCAACT GCTTGCGCGT TTTCCTGCAA AACATATTTA TTGCTGATTG TGCGGGGAGA
        TTACAAGCCG TAGTGACAAG AAGTCGCGGG TGACGTTGAC TTAGAGTTGA CGAACGCGCA AAAGGACGTT TTGTATAAAT AACGACTAAC ACGCCCCTCT cscA
1301    GACAGATTGA TGCTGCTGGC GTAACGACTC AGCTTCGTGT ACCGGGCGTT GTAGAAGTTT GCCATTGCTC TCTGATAGCT CGCGCGCCAG CGTCATGCAG
        CTGTCTAACT ACGACGACCG CATTGCTGAG TCGAAGCACA TGGCCCGCAA CATCTTCAAA CGGTAACGAG AGACTATCGA GCGCGCGGTC GCAGTACGTC cscA
1401    CCTGCCCATC CTTCACGTTT TGAGGGCATT GGCGATTCCC ACATATCCAT CCAGCCGATA ACAATACGCC GACCATCCTT CGCTAAAAAG CTTTGTGGTG
        GGACGGGTAG GAAGTGCAAA ACTCCCGTAA CCGCTAAGGG TGTATAGGTA GGTCGGCTAT GTTATGCGG CTGGTAGGAA GCGATTTTTC GAAACACCAC cscA
1501    CATAAAAGTC ATGCCCGTTA TCAAGTTCAG TAAAATGCCC GGATTGTGCA AAAGTCGTC CTGGCGACCA CATTCCGGGT ATTACGCCAC TTTGAAAGCC
        GTATTTTCAG TACGGGCAAT AGTTCAAGTC ATTTTACGGG CCTAACACGT TTTTCAGCAG GACCGCTGGT GTAAGGCCCA TAATGCGGTG AAACTTTCGC cscA
1601    ATTTCGGTAA CTGTATCCCT CGGCATTCAT TCCCTGCGGG GAAAACATCA GATAATGCTG ATCGCCAAGG CTGAAAAAGT CCGGACATTC CCACATATAG
        TAAAGCCATT GACATAGGGA GCCGTAAGTA AGGGACGCCC CTTTTGTAGT CTATTACGAC TAGCGGTTCC GACTTTTCA GGCCTGTAAG GGTGTATATC cscA
1701    CTTTCACCCG CATCAGCGTG GGCCAGTACG CGATCGAAGG TCCATTCACG CAACGAACTG CCGCGATAAA GCAGGATCTG CCCCGTGTTG CCTGGATCTT
        GAAAGTGGGC GTAGTCGCAC CCGGTCATGC GCTAGCTTCC AGGTAAGTGC GTTGCTTGAC GGCGCTATTT CGTCCTAGAC GGGGCACAAC GGACCTAGAA cscA
1801    TCGCCCCGAC TACCATCCAC CATGTGTCGG CTTCACGCCA CACTTTAGGA TCGCGGAAGT GCATGATTCC TTCTGGTGGA GTGAGGATCA CACCCTGTTT
        AGCGGGGCTG ATGGTAGGTG GTACACAGCC GAAGTGCGGT GTGAAATCCT AGCGCCTTCA CGTACTAAGG AAGACCACCT CACTCCTAGT GTGGGACAAA cscA
1901    CTCGAAATGA ATACCATCCC GACTGGTAGC CAGACATTGT ACTTCGCAA TTGCATCGTC ATTACCTGCA CCATCGAGCC AGACGTGTCC GGTGTAGATA
        GAGCTTTACT TATGGTAGGG CTGACCATCG GTCTGTAACA TGAAGCGCTT AACGTAGCAG TAATGACGT GGTAGCTCGG TCTGCACAGG CCACATCTAT cscA
2001    AGTGAGAGGA CACCATTGTC ATCGACAGCA CTACCTGAAA AACACCCGTC TTTGTCATTA TCGTCTCCTG GCGCTAGCGC AATAGGCTCA TGCTGCCAGT
        TCACTCTCCT GTGGTAACAG TAGCTGTCGT GATGGACTTT TTGTGGGCAG AAACAGTAAT AGCAGAGGAC CGCGATCGCG TTATCCGAGT ACGACGGTCA cscA
2101    GGATCATATC GTCGCTGGTC GCATGTCCCC AGTGCATTGG CCCCCAGTGT TCGCTCATCC GATGATGTTG ATAAAACGCG TGATAACGAT CGTTAAACCA
        CCTAGTATAG CAGCGACCAC CGTACAGGGG TCACGTAACC GGGGGTCACA AGCGAGTAGC CTACTACAAC TATTTTGCGC ACTATTGCTA GCAATTTGGT cscA
```

```
2201  GATCAGGCCG TTTGGATCGT TCATCCACCC GGCAGGAGCC GCGAGGTGAA AATGGGCATA GAAAGTGTTA CCCCGGTGCT CATGAAGTTT TCCTAGGGCG
      CTAGTCCGGC AAACCTAGCA AGTAGGTGGG CCGTCCTCCG CGCTCCACTT TTACCCCTAT CTTTCACAAT GGGGCCACGA GTACTTCAAA ACGATCCCGC
                                                                  ~~~~~~~~~~~~~~~~~~~~~~~~~~~~~~~~~~~~~~~~~~~~~~~~~
                                                                  cscA
2301  TTTTGCGCCG CATGCAATCG AGATTCGTC ATTTTAATCA TCCTGGTTAA GCAAATTTGG TGAATTGTTA ACGTTAACTT TTATAAAAAT AAAGTCCCTT
      AAAACGCGGC GTACGTTAGC TCTAACGCAG TAAAATTAGT AGGACCAATT CGTTAAACC ACTTAACAAT TGCAATTGAA AATATTTTA TTTCAGGGAA
      ~~~~~~~~~~~~~~~~~~<
                cscA
2401  ACTTTCATAA ATGCGATGAA TATCACAAAT GTTAACGTTA ACTATGACGT TTTGTGATCG AATATGCATG TTTTAGTAAA TCCATGACGA TTTTGCGAAA
      TGAAAGTATT TACGCTACTT ATAGTGTTTA CAATTGCAAT TGATACTGCA AAACACTAGC TTATACGTAC AAAATCATTT AGGTACTGCT AAAACGCTTT
                                                                                                        cscK
                                                                                       >~~~~~~~~~~~~~~~~~~~~~~~~~~~~
2501  AAGAGGTTTA TCACTATGCG TAACTCAGAT GAATTTAAGG GAAAAAAATG TCAGCCAAAG TATGGGTTTT AGGGGATGCG GTCGTAGATC TCTTGCCAGA
      TTCTCCAAAT AGTGATACGC ATTGAGTCTA CTTAAATTCC CTTTTTTTAC AGTCGGTTTC ATACCCAAAA TCCCCTACGC CAGCATCTAG AGAACGGTCT
                                                                     cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
2601  ATCAGACGGG CGCCTACTGC CTTGTCCTGG CGGCGCGCCA GCTAACGTTG CGGTGGGAAT CGCCAGATTA GGCGGAACAA GTGGGTTTAT AGGTCGGGTG
      TAGTCTGCCC GCGGATGACG GAACAGGACC GCCGCGCGGT CGATTGCAAC GCCACCCTTA GCGGTCTAAT CCGCCTTGTT CACCCAAATA TCCAGCCCAC
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
2701  GGGGATGATC CTTTTGGTGC GTTAATGCAA AGAACGCTGC TAACTGAGGG AGTCGATATC ACGTATCTGA AGCAAGATGA ATGGCACCGG ACATCCACGG
      CCCCTACTAG GAAAACCACG CAATTACGTT TCTTGCGACG ATTGACTCCC TCAGCTATAG TGCATAGACT TCGTTCTACT TACCGTGGCC TGTAGGTGCC
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
2801  TGCTTGTCGA TCTGAACGAT CAAGGGGAAC GTTCATTTAC GTTTATGGTC CGCCCCAGTG CCGATCTTTT TTAGAGACG ACAGACTTGC CCTGCTGGCG
      ACGAACAGCT AGACTTGCTA GTTCCCCTTG CAAGTAAATG CAAATACCAG GCGGGGTCAC GGCTAGAAAA AAATCTCTGC TGTCTGAACG GGACGACCGC
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
2901  ACATGGCGAA TGGTTACATC TCTGTTCAAT TGCGTTGTCT GCCGAGCCTT CGCGTACCAG CGCATTTACT GCGATGACGG CGATCCGGCA TGCCGGAGGT
      TGTACCGCTT ACCAATGTAG AGACAAGTTA ACGCAACAGA CGGCTCGGAA GCGCATGGTC GCGTAAATGA CGCTACTGCC GCTAGGCCGT ACGGCCTCCA
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
3001  TTTGTCAGCT TCGATCCTAA TATTCGTGAA GATCTATGGC AAGACGAGCA TTTGCTCCGC TTGTGTTTGC GGCAGGCGCT ACAACTGGCG GATGTCGTCA
      AAACAGTCGA AGCTAGGATT ATAAGCACTT CTAGATACCG TTCTGCTCGT AAACGAGGCG AACACAAACG CCGTCCGCGA TGTTGACCGC CTACAGCAGT
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
3101  AGCTCTCGGA AGAAGAATGG CGACTTATCA GTGGAAAAAC ACAGAACGAT CAGGATATAT GCGCCCTGGC AAAAGAGTAT GAGATCGCCA TCCTGTTGGT
      TCGAGAGCCT TCTTCTTACC GCTGAATAGT CACCTTTTTG TGTCTTGCTA GTCCTATATA CGCGGGACCG TTTTCTCATA CTCTAGCGGT AGGACAACCA
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
3201  GACTAAAGGT GCAGAAGGGG TGGTGGTCTG TTATCGAGGA CAAGTTCACC ATTTTGCTGG AATGTCTGTG AATTGTGTCG ATAGCACGGG GGCGGGAGAT
      CTGATTTCCA CGTCTTCCCC ACCACCAGAC AATAGCTCCT GTTCAAGTGG TAAAACGACC TTACAGACAC TTAACACAGC TATCGTGCCC CCGCCCTCTA
                                                                       cscK
      ~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~~
3301  GCGTTCGTTG CCGGGTTACT CACAGGTCTG TCCTCTACGG GATTATCTAC AGATGAGAGA GAAATGCGAC GAATTATCGA TCTCGCTCAA CGTTGCGGAG
      CGCAAGCAAC GGCCCAATGA GTGTCCAGAC AGGAGATGCC CTAATAGATG TCTACTCTCT CTTTACGCTG CTTAATAGCT AGAGCGAGTT GCAACGCCTC
                                                                       cscK
```

FIG. 55 (cont'd)

```
3401    CGCTTGCAGT AACGGCGAAA GGGGCAATGA CAGCGGCTGCC ATGTCGACAA GAACTGGAAT AGTGAGAAGT AAACGGCGAA GTCGCTCTTA TCTCTAAATA
        GCGAACGTCA TTGCCGCTTT CCCCGTTACT GTCGCGACGG TACAGCTGTT CTTGACCTTA TCACTCTTCA TTTGCCGCTT CAGCGAGAAT AGAGATTTAT
                                                                    cscB
                            >
3501    GGACGTGAAT TTTTTAACGA CAGGCAGGTA ATTATGGCAC TGAATATTCC ATTCAGAAAT GCGTACTATC GTTTTGCATC CAGTTACTCA TTTCTCTTTT
        CCTGCACTTA AAAAATTGCT GTCCGTCCAT TAATACCGTG ACTTATAAGG TAAGTCTTTA CGCATGATAG CAAAACGTAG GTCAATGAGT AAAGAGAAAA
                                                                    cscB 3601    TTATTTCCTG GTCGCTGTGG TGGTCGTTAT ACGCTATTTG GCTGAAAGGA CATCTAGGGT TGACAGGGAC GGAATTAGGT ACACTTTATT CGGTCAACCA
        AATAAAGGAC CAGCGACACC ACCAGCAATA TGCGATAAAC CGACTTTCCT GTAGATCCCA ACTGTCCCTG CCTTAATCCA TGTGAAATAA GCCAGTTGGT
                                                                    cscB 3701    GTTTACCAGC ATTCTATTTA TGATGTTCTA CGGCATCGTT CAGGATAAAC TCGGTCTGAA GAAACTGCTC ATCGGTGTA TGAGTTTCAT CCTGGTCTTG
        CAAATGGTCG TAAGATAAAT ACTACAAGAT GCCGTAGCAA GTCCTATTTG AGCCAGACTT CTTTGGCCAG TAGACCACAT ACTCAAAGTA GGACCAGAAC
                                                                    cscB 3801    ACCGGACCGT TTATGATTTA CGTTTATGAA CCGTTACTGC AAAGCAATTT TCTGTAGGT CTAATTCTGG GGGCGCTATT TTTTGGCTTG GGGTATCTGG
        TGGCCTGGCA AATACTAAAT GCAAATACTT GGCAATGACG TTTCGTTAAA AAGACATCCA GATTAAGACC CCGCGATAA AAAACCGAAC CCCATAGACC
                                                                    cscB 3901    CGGGATGCGG TTTGCTTGAT AGCTTCACCG AAAAAATGGC GCGAAATTTT CATTCCGAAT ATGGAACAGC GCGCGCCTGG GGATCTTTTG GCTATGCTAT
        GCCCTACGCC AAACGAACTA TCGAAGTGGC TTTTTTACGG CGCTTTAAAA GTAAAGCTTA TACCTTGTCG CGCGCGGACC CCTAGAAAAC CGATACGATA
                                                                    cscB 4001    TGGCGCGTTC TTTGCCGGCA TATTTTTTAG TATCAGTCCC CATATCAACT TCTGGTTGGT CTGCTATTT GGCGCTGTAT TTATGATGAT CAACATGCGT
        ACCGCGCAAG AAACGGCCGT ATAAAAAATC ATAGTCAGGG GTATAGTTGA AGACCAACCA GAGCGATAAA CCGCCACATA AATACTACTA GTTGTACGCA
                                                                    cscB 4101    TTTAAAGATA AGGATCACCA GTGCGTAGCG GCAGATGCGG GAGGGGTAAA AAAAGAGGAT TTATCGCAG TTTCAAGGA TCGAAACTTC TGGGTTTTCG
        AAATTTCTAT TCCTAGTGGT CACGCATCGC CGTCTACGCC CTCCCCATTT TTTTCTCCTA AAATAGCGTC AAAAGTTCCT AGCTTTGAAG ACCCAAAAGC
                                                                    cscB 4201    TCATATTTAT TGTGGGGACG TGGTCTTTCT ATAACATTTT TGATCAACAA CTTTTTCCTG TCTTTTATTC AGGTTTATTC GAATCACACG ATGTAGGAAC
        AGTATAAATA ACACCCCTGC ACCAGAAAGA TATTGTAAAA ACTAGTTGTT GAAAAAGGAC AGAAAATAAG TCCAAATAAG CTTAGTGTGC TACATCCTTG
                                                                    cscB 4301    GCGCCTGTAT GGTTATCTCA ACTCATTCCA GGTGGTACTC GAAGCGCTGT GCATGGCGAT TATTCCTTTC TTTGTGAATC GGGTAGGGCC AAAAAATGCA
        CGCGGACATA CCAATAGAGT TGAGTAAGGT CCACCATGAG CTTCGCGACA CGTACCGCTA ATAAGGAAAG AAACACTTAG CCCATCCCGG TTTTTTACGT
                                                                    cscB 4401    TTACTTATCG GAGTTGTCAT TATGGCGTTG CGTATCCTTT CCTCGCGCGT GTTCGTTAAC CCCTGGATTA TTTCATTAGT GAAGTTGTTA CATGCCATTG
        AATGAATAGC CTCAACACTA ATACCGCAAC GCATAGGAAA GGACGCGCGA CAAGCAATTG GGGACCTAAT AAAGTAATCA CTTCAACAAT GTACGGTAAC
                                                                    cscB 4501    AGGTTCCACT TTGTGTCATA TCCGTCTTCA AATACAGCCGT GGCAAACTTT GATAAGCGCC TGTCGTCGAC GATCTTTCTG ATTGGTTTTC AAATTGCCAG
        TCCAAGGTGA AACACAGTAT AGGCAGAAGT TTATGTCGCA CCGTTTGAAA CTATTCGCGG ACAGCAGCTG CTAGAAAGAC TAACCAAAAG TTTAACGGTC
                                                                    cscB
```

FIG. 55 (cont'd)

```
4601  TTCGCTTGGG ATTGTGCTGC TTTCAACGCC GACTGGGATA CTCTTTGACC ACGCAGGCTA CCAGACAGTT TTCTTCGCAA TTTCGGGTAT TGTCTGCCTG
      AAGCGAACCC TAACACGACG AAAGTTGCGG CTGACCCTAT GAGAAACTGG TGCGTCCGAT GGTCTGTCAA AAGAAGCGTT AAAGCCCATA ACAGACGGAC
                                                                cscB
      ----------------------------------------------------------------------------------------------------

4701  ATGTTGCTAT TTGGCATTTT CTTCTTGAGT AAAAAACGCG AGCAAATAGT TATGGAAACG CCTGTACCTT CAGCAATATA GACGTAAACT TTTTCCGGTT
      TACAACGATA AACCGTAAAA GAAGAACTCA TTTTTTGCGC TCGTTTATCA ATACCTTTGC GGACATGGAA GTCGTTATAT CTGCATTTGA AAAAGGCCAA
4801  GTTCTCGATA GCTCTATATC CCTCAACCGG AAAATAATAA TAGTAAAATG CTTAGCCCTG CTAATAATCG CCTAATCCAA ACGCCTCATT CATGTTCTGG
      CAAGAGCTAT CGAGATATAG GGAGTTGGCC TTTTATTATT ATCATTTTAC GAATCGGGAC GATTATTAGC GGATTAGGTT TGCGGAGTAA GTACAAGACC
4901  TACAGTCGCT CAAATGTACT TCAGATGCGC GGTTCGCTGA TTTCCAGGAC ATTGTCGTCA TTCAGTGACC TGTCCCGTGT ATCACGGTCC TGCGAATTCA
      ATGTCAGCGA GTTTACATGA AGTCTACGCG CCAAGCGACT AAAGGTCCTG TAACAGCAGT AAGTCACTGG ACAGGGCACA TAGTGCCAGG ACGCTTAAGT
5001  TCAAGGAATG CATTGCGGAG TGAAGTATCG AGTCACGCCA TATTCGTCA CCCGAAGATG AGTTTTGAGA TATTAAGGCA GGTGACTTTC ACTCACA
      AGTTCCTTAC GTAACGCCTC ACTTCATAGC TCAGTGCGGT ATAAGCAGT GGGCTTCTAC TCAAAACTCT ATAATTCCGT CCACTGAAAG TGAGTGT
                                                              ~~~~~~~~~~~~~~~~~~~~~~~~~~~~~~~~~~~~~~~~~~~~~
                                                                   ANTISENSE_PRM
```

FIG. 55 (cont'd)

```
ATGGCAGTGGATTCACCGGATGAGCGGCTACAGCGCCGCATTGCACAGTTGTTTGCAGAAGATG
AGCAGGTCAAGGCCGCACGTCCGCTCGAAGCGGTGAGCGCGGCGGTGAGCGCGCCCGGTATGCG
GCTGGCGCAGATCGCCGCCACTGTTATGGCGGGTTACGCCGACCGCCCGGCCGCCGGGCAGCGT
GCGTTCGAACTGAACACCGACGACGCGACGGGCCGCACCTCGCTGCGGTTACTTCCCCGATTCG
AGACCATCACCTATCGCGAACTGTGGCAGCGAGTCGGCGAGGTTGCCGCGGCCTGGCATCATGA
TCCCGAGAACCCCTTGCGCGCAGGTGATTTCGTCGCCCTGCTCGGCTTCACCAGCATCGACTAC
GCCACCCTCGACCTGGCCGATATCCACCTCGGCGCGGTTACCGTGCCGTTGCAGGCCAGCGCGG
CGGTGTCCCAGCTGATCGCTATCCTCACCGAGACTTCGCCGCGGCTGCTCGCCTCGACCCCGGA
GCACCTCGATGCGGCGGTCGAGTGCCTACTCGCGGGCACCACACCGGAACGACTGGTGGTCTTC
GACTACCACCCCGAGGACGACGACCAGCGTGCGGCCTTCGAATCCGCCCGCCGCCGCCTTGCCG
ACGCGGGCAGCTTGGTGATCGTCGAAACGCTCGATGCCGTGCGTGCCCGGGGCCGCGACTTACC
GGCCGCGCCACTGTTCGTTCCCGACACCGACGACGACCCGCTGGCCCTGCTGATCTACACCTCC
GGCAGCACCGGAACGCCGAAGGGCGCGATGTACACCAATCGGTTGGCCGCCACGATGTGGCAGG
GGAACTCGATGCTGCAGGGGAACTCGCAACGGGTCGGGATCAATCTCAACTACATGCCGATGAG
CCACATCGCCGGTCGCATATCGCTGTTCGGCGTGCTCGCTCGCGGTGGCACCGCATACTTCGCG
GCCAAGAGCGACATGTCGACACTGTTCGAAGACATCGGCTTGGTACGTCCCACCGAGATCTTCT
TCGTCCCGCGCGTGTGCGACATGGTCTTCCAGCGCTATCAGAGCGAGCTGGACCGGCGCTCGGT
GGCGGGCGCCGACCTGGACACGCTCGATCGGGAAGTGAAAGCCGACCTCCGGCAGAACTACCTC
GGTGGGCGCTTCCTGGTGGCGGTCGTCGGCAGCGCGCCGCTGGCCGCGGAGATGAAGACGTTCA
TGGAGTCCGTCCTCGATCTGCCACTGCACGACGGGTACGGGTCGACCGAGGCGGGCGCAAGCGT
GCTGCTCGACAACCAGATCCAGCGGCCGCCGGTGCTCGATTACAAGCTCGTCGACGTGCCCGAA
CTGGGGTTACTTCCGCACCGACCGGCCGCATCCGCGCGGTGAGCTGTTGTTGAAGGCGGAGACCA
CGATTCCGGGCTACTACAAGCGGCCCGAGGTCACCGCGGAGATCTTCGACGAGGACGGCTTCTA
CAAGACCGGCGATATCGTGGCCGAGCTCGAGCACGATCGGCTGGTCTATGTCGACCGTCGCAAC
AATGTGCTCAAACTGTCGCAGGGCGAGTTCGTGACCGTCGCCCATCTCGAGGCCGTGTTCGCCA
GCAGCCCGCTGATCCGGCAGATCTTCATCTACGGCAGCAGCGAACGTTCCTATCTGCTCGCGGT
GATCGTCCCCACCGACGACGCGCTGCGCGGCCGCGACACCGCCACCTTGAAATCGGCACTGGCC
GAATCGATTCAGCGCATCGCCAAGGACGCGAACCTGCAGCCCTACGAGATTCCGCGCGATTTCC
TGATCGAGACCGAGCCGTTCACCATCGCCAACGGACTGCTCTCCGGCATCGCGAAGCTGCTGCG
CCCCAATCTGAAGGAACGCTACGGCGCTCAGCTGGAGCAGATGTACACCGATCTCGCGACAGGC
CAGGCCGATGAGCTGCTCGCCCTGCGCCGCGAAGCCGCCGACCTGCCGGTGCTCGAAACCGTCA
GCCGGGCAGCGAAAGCGATGCTCGGCGTCGCCTCCGCCGATATGCGTCCCGACGCGCACTTCAC
CGACCTGGGCGGCGATTCCCTTTCCGCGCTGTCGTTCTCGAACCTGCTGCACGAGATCTTCGGG
GTCGAGGTGCCGGTGGGTGTCGTCGTCAGCCCGGCGAACGAGCTGCGCGATCTGGCGAATTACA
TTGAGGCGGAACGCAACTCGGGCGCGAAGCGTCCCACCTTCACCTCGGTGCACGGCGGCGGTTC
CGAGATCCGCGCCGCCGATCTGACCCTCGACAAGTTCATCGATGCCCGCACCCTGGCCGCCGCC
GACAGCATTCCGCACGCGCCGGTGCCAGCGCAGACGGTGCTGCTGACCGGCGCGAACGGCTACC
TCGGCCGGTTCCTGTGCCTGGAATGGCTGGAGCGGCTGGACAAGACGGGTGGCACGCTGATCTG
CGTCGTGCGCGGTAGTGACGCGGCCGCGGCCCGTAAACGGCTGGACTCGGCGTTCGACAGCGGC
GATCCCGGCCTGCTCGAGCACTACCAGCAACTGGCCGCACGGACCCTGGAAGTCCTCGCCGGTG
ATATCGGCGACCCGAATCTCGGTCTGGACGACGCGACTTGGCAGCGGTTGGCCGAAACCGTCGA
CCTGATCGTCCATCCCGCCGCGTTGGTCAACCACGTCCTTCCCTACACCCAGCTGTTCGGCCCC
```

FIG. 59A

```
AATGTCGTCGGCACCGCCGAAATCGTCCGGTTGGCGATCACGGCGCGGCGCAAGCCGGTCACCT
ACCTGTCGACCGTCGGAGTGGCCGACCAGGTCGACCCGGCGGAGTATCAGGAGGACAGCGACGT
CCGCGAGATGAGCGCGGTGCGCGTCGTGCGCGAGAGTTACGCCAACGGCTACGGCAACAGCAAG
TGGGCGGGGGAGGTCCTGCTGCGCGAAGCACACGATCTGTGTGGCTTGCCGGTCGCGGTGTTCC
GTTCGGACATGATCCTGGCGCACAGCCGGTACGCGGGTCAGCTCAACGTCCAGGACGTGTTCAC
CCGGCTGATCCTCAGCCTGGTCGCCACCGGCATCGCGCCGTACTCGTTCTACCGAACCGACGCG
GACGGCAACCGGCAGCGGGCCCACTATGACGGCTTGCCGGCGGACTTCACGGCGGCGGCGATCA
CCGCGCTCGGCATCCAAGCCACCGAAGGCTTCCGGACCTACGACGTGCTCAATCCGTACGACGA
TGGCATCTCCCTCGATGAATTCGTCGACTGGCTCGTCGAATCCGGCCACCCGATCCAGCGCATC
ACCGACTACAGCGACTGGTTCCACCGTTTCGAGACGGCGATCCGCGCGCTGCCGGAAAAGCAAC
GCCAGGCCTCGGTGCTGCCGTTGCTGGACGCCTACCGCAACCCCTGCCCGGCGGTCCGCGGCGC
GATACTCCCGGCCAAGGAGTTCCAAGCGGCGGTGCAAACAGCCAAAATCGGTCCGGAACAGGAC
ATCCCGCATTTGTCCGCGCCACTGATCGATAAGTACGTCAGCGATCTGGAACTGCTTCAGCTGC
TCTAA
```

FIG. 59A (cont'd)

```
mavdspderlqrriaqlfaedeqvkaarpleavsaavsapgmrlaqiaatvmagyadrpaagqr
afelntddatgrtslrllprfetityrelwqrvgevaaawhhdpenplragdfvallgftsidy
atldladihlgavtvplqasaavsqliailtetsprllastpehldaavecllagttperlvvf
dyhpedddqraafesarrrladagslvivetldavrargrdlpaaplfvpdtdddplalliyts
gstgtpkgamytnrlaatmwqgnsmlqgnsqrvginlnympmshiagrislfgvlarggtayfa
aksdmstlfediglvrpteiffvprvcdmvfqryqseldrrsvagadldtldrevkadlrqnyl
ggrflvavvgsaplaaemktfmesvldlplhdgygsteagasvlldnqiqrppvldyklvdvpe
lgyfrtdrphprgelllkaettipgyykrpevtaeifdedgfyktgdivaelehdrlvyvdrrn
nvlklsqgefvtvahleavfasssplirqifiygssersyllavivptddalrgrdtatlksala
esiqriakdanlqpyeiprdflietepftiangllsgiakllrpnlkerygaqleqmytdlatg
qadellalrreaadlpvletvsraakamlgvasadmrpdahftdlggdslsalsfsnllheifg
vevpvgvvvspanelrdlanyieaernsgakrptftsvhgggseiraadltldkfidartlaaa
dsiphapvpaqtvlltgangylgrflclewlerldktggtlicvvrgsdaaaarkrldsafdsg
dpgllehyqqlaartlevlagdigdpnlglddatwqrlaetvdlivhpaalvnhvlpytqlfgp
nvvgtaeivrlaitarrkpvtylstvgvadqvdpaeyqedsdvremsavrvvresyangygnsk
wagevllreahdlcglpvavfrsdmilahsryagqlnvqdvftrlilslvatgiapysfyrtda
dgnrqrahydglpadftaaaitalgiqategfrtydvlnpyddgisldefvdwlvesghpiqri
tdysdwfhrfetairalpekqrqasvlplldayrnpcpavrgailpakefqaavqtakigpeqd
iphlsaplidkyvsdlellqll*
```

FIG. 59B

```
ATGATTGAAACCATTCTGCCTGCAGGCGTTGAAAGCGCAGAACTGCTGGAATATCCGGAAGATC
TGAAAGCACATCCGGCAGAAGAACATCTGATTGCCAAAAGCGTTGAAAAACGTCGTCGTGATTT
TATTGGTGCACGTCATTGTGCACGTCTGGCACTGGCAGAACTGGGTGAACCTCCGGTTGCAATT
GGTAAAGGTGAACGTGGTGCACCGATTTGGCCTCGTGGTGTTGTTGGTAGCCTGACCCATTGTG
ATGGTTATCGTGCAGCAGCAGTTGCACATAAAATGCGCTTTCGCAGCATTGGTATTGATGCAGA
ACCGCATGCAACCCTGCCGGAAGGTGTTCTGGATAGCGTTAGCCTGCCGCCGGAACGTGAATGG
CTGAAAACCACCGATAGCGCACTGCATCTGGATCGTCTGCTGTTTTGTGCAAAAGAAGCCACCT
ATAAAGCCTGGTGGCCGCTGACAGCACGTTGGCTGGGTTTTGAAGAAGCCCATATTACCTTTGA
AATTGAAGATGGTAGCGCAGATAGCGGTAATGGCACCTTTCATAGCGAACTGCTGGTTCCGGGT
CAGACCAATGATGGTGGTACACCGCTGCTGAGCTTTGATGGTCGTTGGCTGATTGCAGATGGTT
TTATTCTGACCGCAATTGCCTATGCCTAA
```

FIG. 60A

```
mietilpagvesaelleypedlkahpaeehliaksvekrrrdfigarhcarlalaelgeppvai
gkgergapiwprgvvgslthcdgyraaavahkmrfrsigidaephatlpegvldsvslpperew
lkttdsalhldrllfcakeatykawwpltarwlgfeeahitfeiedgsadsgngtfhsellvpg
qtndggtpllsfdgrwliadgfiltaiaya*
```

FIG. 60B

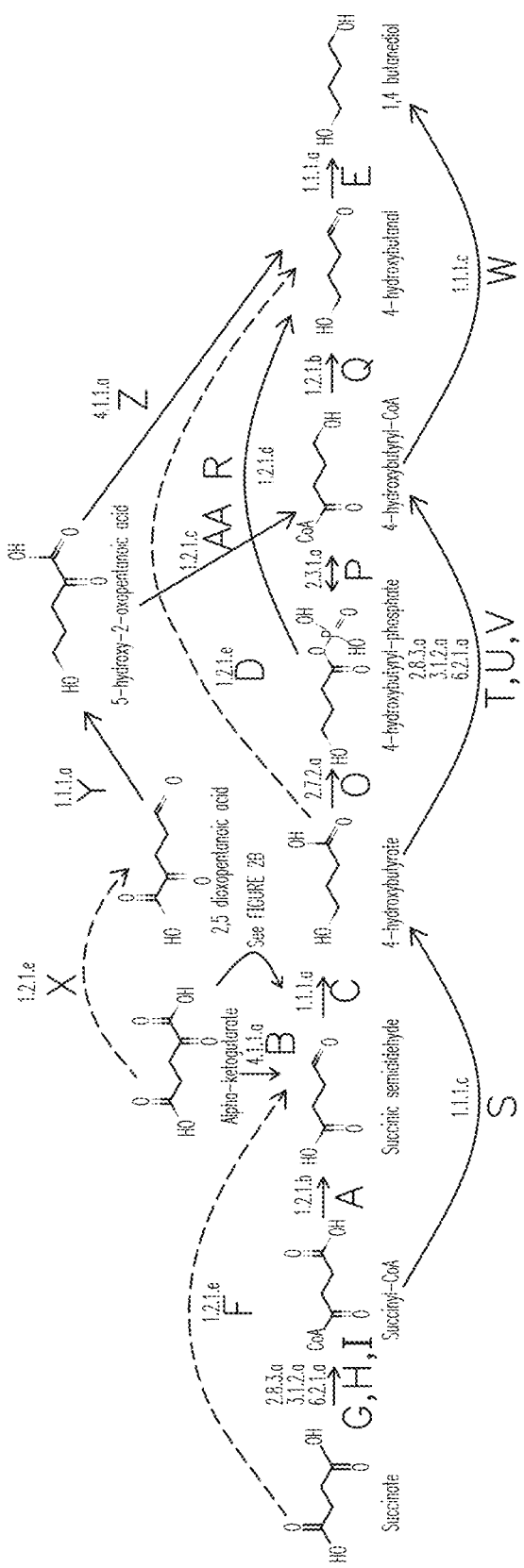
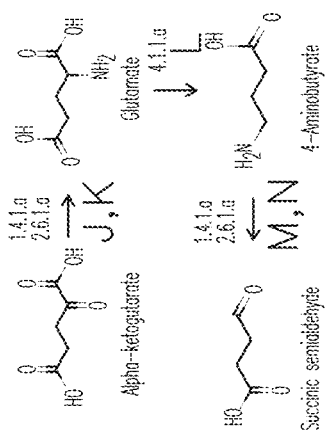
FIG. 62A
FIG. 62B

```
atgaccagcgatgttcacgacgccacagacggcgtcaccgaaaccgcactcgacgacgagcagtcgacccgccgcat
cgccgagctgtacgccaccgatcccgagttcgccgccgccgcaccgttgccgccgtggtcgacgcggcgcacaaac
ccggcgctgcggctggcagagatcctgcagaccctgttcaccggctacggtgaccgccggcgctgggataccgcgcc
cgtgaactggccaccgacgagggcgggcgcaccgtgacgcgtctgctgccgcggttcgacaccctcacctacgcca
ggtgtggtcgcgcgtgcaagcggtcgccgcggcctgcgccacaacttcgcgcagccgatctacccggcgacgccg
tcgcgacgatcggtttcgcgagtcccgattacctgacgctggatctcgtatgcgcctacctgggcctcgtgagtgtt
ccgctgcagcacaacgcaccggtcagccggctcgcccgatcctggcgaggtcgaaccgcggatcctcaccgtgag
cgccgaatacctcgacctcgcagtcgaatccgtgcgggacgtcaactcggtgtcgcagctcgtggtgttcgaccatc
acccgaggtcgacgaccaccgcgacgcactggcccgcgcgcgtgaacaactcgccggcaagggcatcgccgtcacc
accctggacgcgatcgccgacgagggcgccgggctgccggccgaaccgatctacaccgccgaccatgatcagcgcct
cgcgatgatcctgtacacctcgggttccaccggcgcacccaagggtgcgatgtacaccgaggcgatggtggcggc
tgtggaccatgtcgttcatcacgggtgacccacgccggtcatcaacgtcaacttcatgccgctcaaccacctgggc
gggcgcatcccatttccacgccgtgcagaacggtggaaccagttacttcgtaccggaatccgacatgtccacgct
gttcgaggatctcgcgctggtgcgcccgaccgaactcggcctggttccgcgcgtcgccgacatgctctaccagcacc
acctcgccaccgtcgaccgcctggtcacgcagggcgccgacgaactgaccgccgagaagcaggccggtgccgaactg
cgtgagcaggtgctcggcggacgcgtgatcaccggattcgtcagcaccgcaccgctggccgcgggagatgagggcgtt
cctcgacatcaccctggggcgcacacatcgtcgacggctacgggctcaccgagaccggcgccgtgacacgcgacggtg
tgatcgtgcggccaccggtgatcgactacaagctgatcgacgttcccgaactcggctacttcagcaccgacaagccc
tacccgcgtggcgaactgctggtcaggtcgcaaacgctgactcccgggtactacaagcgccccgaggtcaccgcgag
cgtcttcgaccgggacggctactaccacaccggcgacgtcatggccgagaccgcacccgaccacctggtgtacgtgg
acgtcgcaacaacgtcctcaaactcgcgcagggcgagttcgtggcggtcgccaacctggaggcggtgttctccggc
gcggcgctggtgcgccagatcttcgtgtacggcaacagcgagcgcagtttccttctggccgtggtggtcccgacgcc
ggaggcgctcgagcagtacgatccggccgcgctcaaggccgcgctggccgactcgctgcagcgcaccgcacgcgacg
ccgaactgcaatcctacgaggtgccggccgattcatcgtcgagaccgagccgttcagcgccgccaacgggctgctg
tcgggtgtcggaaaactgctgcggcccaacctcaaagaccgctacgggcagcgcctggagcagatgtacgccgatat
cgcggccacgcaggccaaccagttgcgcgaactgcggcgcgcggccgccacacaaccggtgatcgacaccctcaccc
aggccgctgccacgatcctcggcaccgggagcgaggtggcatccgacgcccacttcaccgacctgggcggggattcc
ctgtcggcgctgacactttcgaacctgctgagcgatttcttcggtttcgaagttcccgtcggcaccatcgtgaaccc
ggccaccaacctcgcccaactcgcccagcacatcgaggcgcagcgcaccgcgggtgacgcaggccgagtttcacca
ccgtgcacggcgcggacgccaccgagatccgggcgagtgagctgaccctggacaagttcatcgacgccgaaacgctc
cgggccgcaccgggtctgcccaaggtcaccaccgagccacggacggtgttgctctcgggcgccaacggctggctggg
ccggttcctcacgttgcagtggctggaacgcctggcacctgtcggcggcaccctcatcacgatcgtgcggggccgcg
acgacgccgcggcccgcgcacggctgacccaggcctacgacaccgatcccgagttgtcccgcgcgcttcgccgagctg
gccgacgccacctgcgggtggtcgccggtgacatcggcgacccgaatctgggcctcacaccgagatctggcaccg
gctcgccgccgaggtcgacctggtggtgcatccggcagcgctggtcaaccacgtgctccctaccggcagctgttcg
gccccaacgtcgtgggcacggccgaggtgatcaagctggccctcaccgaacggatcaagcccgtcacgtacctgtcc
acgtgtcggtggccatggggatccccgacttcgaggaggacggcgacatccggaccgtgagccggtgcgccgct
cgacggcggatacgccaacggctacggcaacagcaagtgggccggcgaggtgctgctgcgggaggccacgatctgt
gcgggctgcccgtggcgacgttccgctcggacatgatcctggcgcatccgcgctacgcggtcaggtcaacgtgcca
gacatgttcacgcgactcctgttgagcctcttgatcaccggcgtcgcgccgcggtcgttctacatcggagacggtga
ggcccgcgggcgcactacccggcctgacggtcgatttcgtggccgaggcggtcacgacgctcggcgcgcagcagc
gcgagggatacgtgtcctacgacgtgatgaaccgcacgacgacgggatctccctggatgtgttcgtggactggctg
atccgggcgggccatccgatcgaccgggtcgacgactacgacgactgggtgcgtcggttcgagaccgcgttgaccgc
gcttcccgagaagcgccgcgcacagaccgtactgccgctgctgcacgcgttccgcgctccgcaggcaccgttgcgcg
gcgcacccgaacccacggaggtgttccacgccgcggtgcgcaccgcgaaggtgggccgggagacatccgcacctc
gacgaggcgctgatcgacaagtacatacgcgatctgcgtgagttcggtctgatctaa
```

FIG. 64A

MTSDVHDATDGVTETALDDEQSTRRIAELYATDPEFAAAAPLPAVVDAAHKPGLRLAEILQTLFTGYGDRPALGYRA
RELATDEGGRTVTRLLPREDTLTYAQVWSRVQAVAAALRHNFAQPIYPGDAVATIGFASPDYLTLDLVCAYLGLVSV
PLQHNAPVSRLAPILAEVEPRIILTVSAEYLDLAVESVRDVNSVSQLVVFDHHPEVDDHRDALARAREQLAGKGIAVT
TLDAIADEGAGLPAEPIYTADHDQRLAMILYTSGSTGAPKGAMYTEAMVARLWTMSFITGDPTPVINVNFMPLNHLG
GRIPISTAVQNGGTSYFVPESDMSTLFEDLALVRPTELGLVPRVADMLYQHHLATVDRLVTQGADELTAEKQAGAEL
REQVLGGRVITGFVSTAPLAAEMRAPLDITLGAHIVDGYGLTETGAVTRDGVIVRPFVIDYKLIIDVPELGYFSTDKP
YPRGELLVRSQTLTPGYYKRPEVTASVFDRDGYYHTGDVMAETAPDHLVYVDRRNNVLKLAQGEFVAVANLEAVFSG
AALVRQIFVYGNSERSFLLAVVVPTPEALEQYDPAALKAALADSLQRTARDAELQSYEVPADFIVETEPFSAANGLL
SGVGKLLRPNLKDRYGQRLEQMYADIAATQANQLRELRRAAATQPVIDTLTQAAATILGTSEVASDAHFTDLGGDS
LSALTLSNLLSDFFGFEVFVGTIVNPATNLAQLAQHIEAQRTAGDRRPSFTTVHGADATEIRASELTLDKFIDAETL
RAAPGLPKVTTEPRTVLSGANGWLGRFLTLQWLERLAPVGGTLITIVRGRDDAAARARLITQAYDTDPELSRRFAEL
ADRHLRVVAGDIGDPNLGLTPEIWHRLAAEVDLVVHPAALVNHVLPYRQLFGPNVVGTAEVIKLALTERIKFVTYLS
TVSVAMGIPDFEEDGDIRTVSPVRPLDGGYANGYGNSKWAGEVLLREAHDLCGLPVATFRSDMILAHPRYRGQVNVP
DMFTRLLLSLLITGVAPRSFYIGDGERPRAHYPGLTVDFVAEAVTTLGAQQREGYVSYDVMNPHDDGISLDVFVDWL
IRAGHPIDRVDDYDDWVRRFETALTALPEKRRACTVLPLLHAFRAPQAPLRGAPEPTEVFHAAVRTAKVGPGDIPHL
DEALIDKYIRDLREFGLI

FIG. 64B

```
atgtcgactgccaccatgacgaacgactcgaccgtcgcgtccacgaactcatcgccaccgaccgcaattcgccgc
cgccaacccgacccggcgatcaccgccgccctcgaacagcccgggctgcggctgccgcagatcatccgcaccgtgc
tcgacggctacgccgaccggccggcgctgggacagcgcgtggtggagttcgtcacggacgccaagaccgggcgacg
tcggcgcagctgctccccgcttcgagaccatcacgtacagcgaagtagcgcagcgtgtttcggcgctgggccgcgc
cctgtccgacgacgcggtgcaccccggcgaccgggtgtgcgtgctgggcttcaacagcgtcgactacgccaccatcg
acatggcgctgggcgccatcggcgccgtctcggtgccgctgcagaccagcgcggcaatcagctcgctgcagccgatc
gtggccgagaccgagcccaccctgatcgcgtccagcgtgaaccagctgtccgacgcggtgcagctgatcaccggcgc
cgagcaggcgcccaccggctggtggtgttcgactaccaccgcaggtcgacgaccagcgcgaggccgtccaggacg
ccgcggcgcggctgtccagcaccggcgtggccgtccagacgctggccgagctgctggagcgcggcaaggacctgccc
gccgtcgcggagccgccgccgacgaggactcgctggccctgctgatctacacctccgggtccaccgccgccccaa
gggcgcgatgtacccacagagcaacgtcggcaagatgtggcgccgcggcagcaagaactggttcggcgagagcgccg
cgtcgatcaccctgaacttcatgccgatgagccacgtgatgggccgaagcatcctctacgcacgctgggcaacggc
ggcaccgcctacttcgccgccgcagcgacctgtccaccctgcttgaggacctcgagctggtgcggcccaccgagct
caacttcgtcccgcggatctgggagacgctgtacggcgaattccagcgtcaggtcgagcggcggctctccgaggccg
gggacgccggcgaacgtcgcgccgtcgaggccgaggtgctggccgagcagcgccagtacctgctgggcgggcggttc
accttcgcgatgacgggctcggcgcccatctcgccggagctgcgcaactgggtcgagtcgctgctcgaaatgcacct
gatggacggctacggctccaccgaggccggaatggtgttgttcgacggggagattcagcgcccgccggtgatcgact
acaagctggtcgacgtgccggacctgggctacttcagcaccgaccggccgcatccgcgcggcgagctgctgctgcgc
accgagaacatgttcccgggctactacaagcgggccgaaaccaccgcgggcgtcttcgacgaggacggctactaccg
caccggcgacgtgttcgccgagatcgcccggaccggctggtctacgtcgaccgccgcaacaacgtgctcaagctgg
cgcagggcgaattcgtcacgctggccaagctggaggcggtgttcggcaacagcccgctgatccgccagatctacgtc
tacggcaacagcgcccagccctacctgctggccgtcgtggtgcccaccgaggaggcgctggcctcgggtgacccca
gacgctcaagcccaagatcgccgactcgctgcagcaggtcgccaaggaggccggcctgcagtcctacgaggtgccgc
gcgacttcatcatcgagaccacccgttcagcctggaaaacggtctgctgaccgggatccggaagctggcgtggccg
aaactgaagcagcactacggggaacggctggagcagatgtacgccgacctggccgccggacaggccaacgagctggc
cgagctgcgccgcaacggtgcccaggcgccggtgttgcagaccgtgagccgcgccgggcgccatgctgggttcgg
ccgcctccgacctgtccccgacgcccacttcaccgatctgggcggagactcgttgtcggcgttgacattcggcaac
ctgctgcgcgagatcttcgacgtcgacgtgccggtaggcgtgatcgtcagccggccaacgacctggcggccatcgc
gagctacatcgaggccgagcggccagcggcagcaagcgcgaacgttcgcctcggtgcacggccggacgcgcacgtgg
tgcgcgccgacctgcgctggacaagtcctcgacgccgagacgctggccgccgcgccgaacctgcccaagccg
gccaccgaggtgcgcaccgtgctgctgaccgcgccaccggcttcctgggccgctacctggccctggaatggctgga
gcggatggacatggtggacggcaaggtcatcgccctggtccgggcccgctccgacgaggaggcacgcgcccggctgg
acaagaccttcgacagcggcgacccgaaactgctcgcgcactaccagcagctggccgccgatcacctggaggtcatc
gccggcgacaagggcgaggccaatctgggcctgggccaagacgtttggcaacgactggccgacacggtcgacgtgat
cgtcgaccccgccgcgctggtcaaccacgtgttgccgtacagcgagctgttcgggccaacgccctgggcaccgcgg
agctgatccggctggcgctgacgtccaagcagaagccgtacacctacgtgtccaccatcggcgtgggcgaccagatc
gagccgggcaagttcgtcgagaacgccgacatccggcagatgagcgccaccggggcgatcaacgacagctacgccaa
cggctatggcaacagcaagtgggccggcgaggtgctgctgcgcgaggcgcacgacctgtgcgggctgccgtcgcgg
tgttccgctgcgacatgatcctggccgacaccacgtatgccgggcagctcaacctgccggacatgttcaccggctg
atgctgagcctggtggccaccgggatcgcgccggctcgttctacgagctcgacgccgacggcaaccggcagcgggc
gcactacgacggcctgccggtcgagttcatcgccgcggcgatctcgacgctgggttcgcagatcaccgacagcgaca
ccggcttccagacctaccacgtgatgaaccctacgatgacggcgtcggtctggacgagtacgtcgattggctggtg
gacgccggctattcgatcgagcggatcgccgactactccgaatggctgcggcggttcgagaccctcgctgcgggcct
gccggaccggcagcgccagtactcgctgctgccgctgctgcacaactaccgcacgcggagaagccgatcaacgggt
cgatagctcccacgacgtgttccgggcagcggtgcaggaggcgaaaatcggcccgacaaagacattccgcacgtg
tcgccgccggtcatcgtcaagtacatcaccgacctgcagctgctcgggctgctctaa
```

FIG. 65A

MSTATHDERLDRRVHELIATDPQFAAAQPDPAITAALEQPGLRLPQIIRTVLDGYADRPALGQRVVEFVTDAKTGRT
SAQLLPRFETITYSEVAQRVSALGRALSDDAVHPGDRVCVLGFNSVDYATIDMALGAIGAVSVPLQTSAAISSLQPI
VAETEPTLIASSVNQLSDAVQLITGAEQAPTRLVVFDYHPQVDDQREAVQDAAARLSSTGVAVQTLAELLERGKDLP
AVAEPPADEDSLALLIYTSGSTGAPKGAMYPQSNVGKMWRRGSKNWFGESAASITLNFMPMSHVMGRSILYGTLGNG
GTAYFAARSDLSTLLEDLELVRPTELNFVPRIWETLYGEFQRQVERRLSEAGDAGERRAVEAEVLAEQRQYLLGGRF
TFAMTGSAPISPELRNWVESLLEMHLMDGYGSTEAGMVLFDGEIQRPPVIDYKLVDVPDLGYFSTDRPHPRGELLLR
TENMFPGYVKRAETTAGVFDEDGYYRTGDVFAEIAPDRLVYVDRRNNVLKLAQGEFVTLAKLEAVFGNSPLIRQIYV
YGNSAQPYLLAVVVPTEEALASGDPETLKPKIADSLQQVAKEAGLQSYEVPRDFIETTPFSLENGLLTGIRKLAWP
KLKQHYGERLEQMYADLAAGQANELAELRRNGAQAFVLQTVSRAAGAMLGSAASDLSPDAHFTDLGGDSLSALTFGN
LLREIFDVDVPVGVIVSPANDLAAIASYIEAERQGSKRPTFASVHGRDATVVRAADLTLDKFLDAETLAAAPNLPKP
ATEVRTVLLTGATGFLGRYLALEWLERMDMVDGKVIALVRARSDEEARARLDKTFDSGDPKLLAHYQQLAADHLEVI
AGDKGEANLGLGQDVWQRLADTVDVIVDPAALVNHVLPYSELFGPNALGTAELIRLALTSKQKPYTYVSTIGVGDQI
EPGKFVENADIRQMSATRAINDSYANGYGNSKWAGEVLLREAHDLCGLPVAVFRCDMILADTTYAGQLNLPDMFTRL
MLSLVATGIAPGSFYELDADGNRQRAHYDGLPVEFIAAAISTLGSQITDSDTGFQTYHVMNPYDDGVGLDEYVDWLV
DAGYSIERIADYSEWLRRFETSLRALFDRQRQYSLLPLLHNYRTFEKPINGSIAPTDVFRAAVQEAKIGFDKDIPHV
SPPVIVKYITDLQLLGLL

FIG. 65B

```
atgtcgccaatcacgcgtgaagagcggctcgagcgccgcatccaggacctctacgccaacgacccgcagttcgccgc
cgccaaacccgccacggcgatcaccgcagcaatcgagcggcgggtctaccgctaccccagatcatcgagaccgtca
tgaccggatacgccgatcggccggctctcgctcagcgctcggtcgaattcgtgaccgacgccggcaccggccacacc
acgctgcgactgctcccccacttcgaaaccatcagctacggcgagctttgggaccgcatcagcgcactggccgacgt
gctcagcaccgaacagacggtgaaaccgggcgaccgggtctgcttgttgggcttcaacagcgtcgactacgccacga
tcgacatgactttggcgcggctgggcgcggtggccgtaccactgcagaccagcgcggcgataaccagctgcagccg
atcgtcgccgagacccagccaccatgatcgcggcagcgtcgacgcactcgctgacgccaccgaattggctctgtc
cggtcagaccgctaccgagtcctggtgttcgaccaccaccggcaggttgacgcacaccgcgcagcggtcgaatccg
cccggagcgcctggccggctcggcggtcgtcgaaacccggccgaggccatcgcgcgcggcgacgtgcccgcggt
gcgtccgccggctcggcgcccggcaccgatgtgtccgacgactcgctcgcgctactgatctacacctcggggcagcac
gggtgcgccaagggcgcgatgtaccccgacgcaacgttgcgaccttctggcgcaagcgcacctggttcgaaggcg
gctacgagccgtcgatcacgctgaacttcatgccaatgagccacgtcatgggccgccaaatcctgtacggcacgctg
tgcaatggcggcaccgcctacttcgtggcgaaaagcgatctctccaccttgttcgaagacctggcgctggtgcggcc
caccgagctgaccttcgtgccgcgcgtgtgggacatggtgttcgacgagtttcagagtgaggtcgaccgccgcctgg
tcgacggcgccgacccgggtcgcgctcgaagcccaggtcaaggccgagatacgcaacgacgtgctcggtggacggtat
accagcgcactgaccggctccgcccctatctccgacgagatgaaggcgtgggtcgaggagctgctcgacatgcatct
ggtcgagggctacggctccaccgaggccgggatgatcctgatcgacggagccattcggcgcccggcggtactcgact
acaagctggtcgatgttcccgacctgggttacttcctgaccgaccggccacatccgcggggcgagttgctggtcaag
accgatagtttgttccccgggctactaccagcgagccgaagtcaccgccgacgtgttcgatgctgacggcttctaccg
gaccggcgacatcatggccgaggtcggccccgaacagttcgtgtacctcgaccgccgcaacaacgtgttgaagctgt
cgcagggcgagttcgtcaccgtctccaaactcgaagcggtgtttggcgacagcccactggtacggcagatctacatc
tacggcaacagcgcccgtgcctacctgttggcggtgatcgtccccacccaggaggcgctggacgccgtgcctgtcga
ggagctcaagggcgcggctgggcgactcgctgcaagaggtcgcaaaggccgccggcctgcagtcctacgagatcccgc
gcgacttcatcatcgaaacaaccatgacggacgtcggagaacggcctgtcaccggcatccgcaagttggccaggccg
cagctgaaaaagcattacggcgagcttctcgagcagatctacacggacctggcacacggccaggcgacgaactgcg
ctcgctgcgccaaagcggtgccgatgccggtgctggtgacggtgtgccgtgcggcggccgcgctgttgggcggca
gcgcctctgacgtccagcccgatgcgcacttcaccgatttgggcggcgactcgctgtcggcgctgtcgttcaccaac
ctgctgcacgagatcttcgacatcgaagtgccggtgggcgtcatcgtcagcccgccaacgacttgcaggcctggc
cgactacgtcgaggcggctcgcaaacccggctcgtcacggccgaccttcgcctcggtccacggcgcctcgaatgggc
aggtcaccgaggtgcatgccggtgacctgtccctggacaaattcatcgatgccgcaaccctggccgaagctccccgg
ctgccgccgcaaacacccaagtgcgcaccgtgctgctgaccggcgccaccggcttcctcgggcgctacctggccct
ggaatggctggagcggatggacctggtcgacggcaaactgatctgcctggtccgggccaagtccgacaccgaagcac
gggcgcggctggacaagacgttcgacagcggcgaccccgaactgctggcccactaccgcgcactggccggcgaccac
ctcgaggtgctcgccggtgacaagggcgaagccgacctcggactggaccggcagacctggcaacgcctggccgacac
ggtcgacctgatcgtcgaccccgcggccctggtcaaccacgtactgccatacagccagctgttcgggccaacgcgc
tgggcaccgccgagctgctgcggctggcgctcacctccaagatcaagccctacagctacacctcgacaatcggtgtc
gccgaccagatcccgccgtcggcgttcaccgaggacgccgacatccgggtcatcagcgccaccgcgcggtcgacga
cagctacgccaatggctactcgaacagcaagtgggccggcgaggtgctgttgcgcgaggcgcatgacctgtgtggcc
tgccggttgcggtgttccgctgcgacatgatcctggccgacaccacatgggcggacagctcaatgtgccggacatg
ttcaccggatgatcctgagcctggcggccaccggtatcgcgccgggttcgttctatgagcttgcggccgacggcgc
ccggcaacgcgccactatgacggtctgcccgtcgagttcatcgccgaggcgatttcgactttgggtcgcagagcc
aggatggtttccacgtatcacgtgatgaaccctacgacgacggcatcggactcgacgagttcgtcgactggctc
aacgagtccggttcccccatccagcgcatcgctgactatggcgactggctgcagcgcttcgaaaccgcactgcgcgc
actgcccgatcggcagcggcacagctcactgctgcgctgttgcacaactatcggcagccggagcggccccgtccgcg
ggtcgatcgccctaccgatcgcttccgggcagcggtgcaagaggccaagatcggccccgacaaagacattccgcac
gtcggcgcgccgatcatcgtgaagtacgtcagcgacctgcgcctactcggcctgctctaa
```

FIG. 66A

MSPITREERLERRIQDLYANDPQFAAAKPATAITAAIERPGLPLPQIIETVMTGYADRPALAQRSVEFVTDAGTGHT
TLRLLPHFETLSYGELWDRISALADVLSTEQTVKPGDRVCLLGFNSVDYATIDMTLARLGAVAVFLQTSAAITQLQP
IVAETQPTMIAASVDALADATELALSGQTATRVLVFDHHRQVDAHRAAVESARERLAGSAVVETLAEALARGDVPRG
ASAGSAPGTDVSDDSLALLIYTSGSTGAPKGAMYPRRNVATFWRKRTWFEGGYEPSITLNFMPMSHVMGRQILYGTL
CNGGTAYFVAKSDLSTLFEDLALVRPTELTFVPRVWDMVFDEFQSEVDRRLVDGADRVALEAQVKAEIRNDVLGGRY
TSALTGSAPISDEMKAWVEELLDMHLVEGYGSTEAGMILIDGAIRRPAVLDYKLIVDVPDLGYFLTDRPHPRGELLVK
TDSLFPGYYQRAEVTADVFDADGFYRTGDIMAEVGPEQFVTLDRRNNVLKLSQGEFVTVSKLEAVFGDSPLVRQIYI
YGNSARAYLLAVIVPTQEALDAVPVEELKARLGDSLQEVAKAAGLQSYEIPRDFIIETTPWTLENGLLTGIRKLARP
QLKKHYGELLEQIYTDLAHGQADELRSLRQSGADAPVLVTVCRAAAALLGGSASDVQPDAHFTDLGGDSLSALSFTN
LLHEIFDIEVPVGVIVSPANDLQALADYVEAARKPGSSRPTFASVHGASNGQVTEVHAGDLSLDKFIDAATLAEAPR
LPAANTQVRTVLLTGATGFLGRYLALEWLERMDLVDGKLICLVRAKSDTEARARLDKTFDSGDPELLAHYRALAGDH
LEVLAGDKGEADLGLDRQTWQRLADTVDLIVDPAALVNHVLPYSQLFGPNALGTAELLRLALTSKIKPYSYTSTIGV
ADQIPPSAFTEDADIRVISATRAVDDSYANGYSNSKWAGEVLLREAHDLCGLPVAVFRCDMILADTTWAGQLNVPDM
FTRMILSLAATGIAPGSFYELAADGARQRAHYDGLPVEFIAEAISTLGAQSQDGFHTYHVMNFYDDGIGLDEFVDWL
NESGCPIQRIADYGDWLQRFETALRALFDRQRHSSLLPLLHNYRQPERPVRGSIAPTDRFRAAVQEAKIGPDKDIPH
VGAPTIVKYVSDLRLLGLL

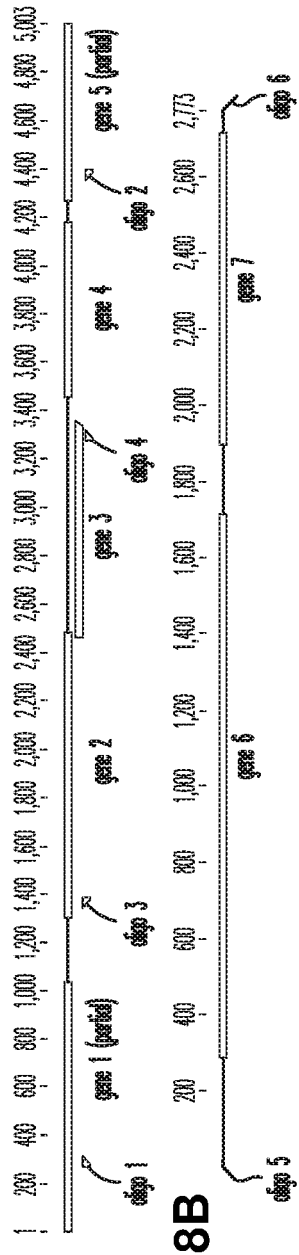
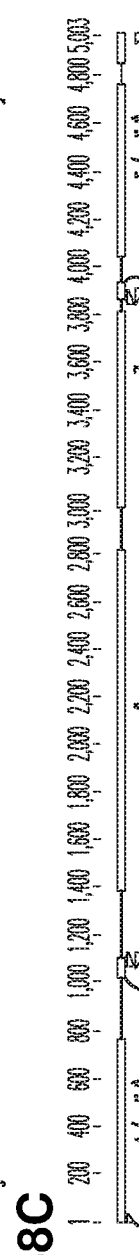
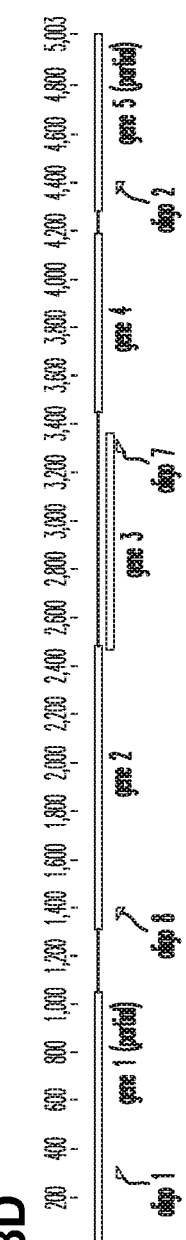
FIG. 68A
FIG. 68B
FIG. 68C
FIG. 68D
FIG. 68E

```
ATGACCGATATTCGCTTGTATATGTTTCAAACTGGCTCGCTGAAGTGCAAAGTCCACAATATCAAAATGA
ATCAAGGAGGTGGAGCGGATTATGAAATCCCTGTCCCGTTCTTCCTGCTGACCCATCCTGATGGTCACAC
GCTGATTGATGGCGGGAATGCTGTCGAAACCGCCACTGATCCCAAAGGGTATTGGGGCGGGATTACCGAG
GTTTATTGGCCGGTAATGCGTGAAGATGAGGGCTGTGTAGCGCAGCTTAAAAAAATGGGGATCAATCCCG
AAGATATCCGGTATGTCTTGCAGTCGCACTTGCATCTTGATCATACCGGTGCGATTGGCCGATTCCCCAA
TGCGACACATCGTTCAGCGCCGTGAGTACGAGTATGCCTTTACTCCTGACTGGTTTGCTGCGGGAGGC
TATATCAGAAACGACTTTGACCGGCCGGGTCTGAAATGGGCGTTTCTGGAAGGCGAAAACAATGATTTTT
ATGATATCTATGGCGACGGTACGCTGAAAACAGTATTTACACCCGGCCATTCGCCTGGGCATCAGTCAAT
ACTGGTCACCTTGCCCAACTCAGGTCCGATGCTACTGACTATTGATGCAGCATACACCACGGATCACTGG
GGAGAAAAAGCTCTGCCAGGATTTATGTCCTCAGCCGTTGAGACGGTGCGTTCGGTGCAGAAGATGCGCA
TGTTGGCTAGCCGCACAAGTGCGCAAGTGGTGACAGGCCATGACCCGGATGCCTGGCAAACGTTCAGGCA
CGCGCCTGAATACTACGATTGA
```

FIG. 89A

```
MTDIRLYMFQTGSLKCKVHNIKMNQGGGADYEIPVPFFLLTHPDGHTLIDGGNAVETATDPKGYWGGITE
VYWPVMREDEGCVAQLKKMGINPEDIRYVLQSHLHLDHTGAIGRFPNATHIVQRREYEYAFTPDWFAAGG
YIRNDFDRPGLKWAFLEGENNDFYDIYGDGTLKTVFTPGHSPGHQSILVTLPNSGPMLLTIDAAYTTDHW
EEKALPGFMSSAVETVRSVQKMRMLASRTSAQVVTGHDPDAWQTFRHAPEYYD
```

FIG. 89B

```
ATGCTTCAGTCGGGTACGCTGAAATGCAAGGTACACAACATTAAGATGAACCAGGGGAACGGTGCAGACT
ATGAGATCCCCGTTCCGTTTTTCCTGATTACCCATCCGGCCGGGCACACCGTGATCGACGGCGGCAACGC
GATTGAAGTTGCAACAGATCCGCGTGGCCATTGGGGCGGCATCTGCGATGTCTATTGGCCAGTACTGGAC
AAGGACCAGGGCTGCGTTGACCAGATCAAGGCGCTTGGTTTCGATCCGGCCGATGTCAAATATGTTGTGC
AGTCGCACCTGCATCTCGATCATACCGGCGCCATCGGTCGCTTCCCCAACGCAACCCACATCGTGCAGCG
CTCTGAATATGAATATGCCTTTACGCCCGACTGGTTTGCTGGCGGCGGCTATATCCGCAAGGACTTCGAC
AAGCCGGGTCTGAAGTGGCAGTTCCTCAACGGTGCGCAGGACGATTATTACGATGTTTACGGCGACGGCA
CGCTCACCACGATCTTCACGCCCGGTCATGCGCCCGGCCACCAGTCCTTCCTGGTGCGCCTGCCAAACAG
CAAACCGCTTCTCCTGACGATCGATGCTGCCTACACACTGGACCACTGGGAAGAGAAGGCTTTGCCTGGC
TTCCTTGCCTCGACCGTTGACACGGTCCGTTCTGTTCAGAAGCTCCGCACCTATGCCGAAAAGCATGATG
CGACAGTCGTCACCGGCCATGACCCTGACGCCTGGGCGAACTTCAAGAAGGCTCCCGAATTTTACGCGTA
A
```

FIG. 90A

```
MLQSGTLKCKVHNIKMNQGNGADYEIPVPFFLITHPAGHTVIDGGNAIEVATDPRGHWGGICDVYWPVLD
KDQGCVDQIKALGFDPADVKYVVQSHLHLDHTGAIGRFPNATHIVQRSEYEYAFTPDWFAGGGYIRKDFD
KPGLKWQFLNGAQDDYYDVYGDGTLTTIFTPGHAPGHQSFLVRLPNSKPLLLTIDAAYTLDHWEEKALPG
FLASTVDTVRSVQKLRTYAEKHDATVVTGHDPDAWANFKKAPEFYA
```

FIG. 90B

MICROORGANISMS AND METHODS FOR PRODUCTION OF 4-HYDROXYBUTYRATE, 1,4-BUTANEDIOL AND RELATED COMPOUNDS

This application is a continuation of U.S. application Ser. No. 14/262,461, filed Apr. 25, 2014, which claims the benefit of priority of U.S. Provisional application Ser. No. 61/854,611, filed Apr. 26, 2013, the entire contents of which are incorporated herein by reference.

This invention was made with government support under grant number DE-EE0005002 awarded by the Department of Energy. The government has certain rights in the invention.

BACKGROUND OF THE INVENTION

The instant application contains a Sequence Listing which has been submitted electronically in ASCII format and is hereby incorporated by reference in its entirety. Said ASCII copy, created on Jan. 10, 2020, is named 12956-403-999 SL.txt and is 1,494,741 1,501,332 bytes in size.

This invention relates generally to in silico design of organisms and engineering of organisms, more particularly to organisms having 1,4-butanediol, 4-hydroxybutyryl-CoA, 4-hydroxybutanal or putrescine biosynthesis capability.

The compound 4-hydroxybutanoic acid (4-hydroxybutanoate, 4-hydroxybutyrate, 4-HB) is a 4-carbon carboxylic acid that has industrial potential as a building block for various commodity and specialty chemicals. In particular, 4-HB has the potential to serve as a new entry point into the 1,4-butanediol family of chemicals, which includes solvents, resins, polymer precursors, and specialty chemicals. 1,4-Butanediol (BDO) is a polymer intermediate and industrial solvent with a global market of about 3 billion lb/year. BDO is currently produced from petrochemical precursors, primarily acetylene, maleic anhydride, and propylene oxide.

For example, acetylene is reacted with 2 molecules of formaldehyde in the Reppe synthesis reaction (Kroschwitz and Grant, *Encyclopedia of Chem. Tech.*, John Wiley and Sons, Inc., New York (1999)), followed by catalytic hydrogenation to form 1,4-butanediol. It has been estimated that 90% of the acetylene produced in the U.S. is consumed for butanediol production. Alternatively, it can be formed by esterification and catalytic hydrogenation of maleic anhydride, which is derived from butane. Downstream, butanediol can be further transformed; for example, by oxidation to γ-butyrolactone, which can be further converted to pyrrolidone and N-methyl-pyrrolidone, or hydrogenolysis to tetrahydrofuran. These compounds have varied uses as polymer intermediates, solvents, and additives, and have a combined market of nearly 2 billion lb/year. It is desirable to develop a method for production of these chemicals by alternative means that not only substitute renewable for petroleum-based feedstocks, and also use less energy- and capital-intensive processes.

Thus, there exists a need for alternative means for effectively producing commercial quantities of 1,4-butanediol and its chemical precursors. The present invention satisfies this need and provides related advantages as well.

SUMMARY OF INVENTION

The invention provides non-naturally occurring microbial organisms having a 4-hydroxybutyrate, 1,4-butanediol, or other product pathway and being capable of producing 4-hydroxybutyrate, 1,4-butanediol, or other product wherein the microbial organism comprises one or more genetic modifications. The invention additionally provides methods of producing 4-hydroxybutyrate, 1,4-butanediol, or other product or related products using the microbial organisms.

The present invention also provides polypeptides and encoding isolated nucleic acid molecules. The polypeptides and nucleic acid molecules can be used in the production of 4-HB, GBL, 4-HBal, 4-HBCoA, BDO and/or putrescine. The invention also provides vectors containing the nucleic acid molecules, host cells containing the vectors and/or expressing the polypeptides of the invention, culture medium containing the host cells of the invention, methods of constructing the host cells of the invention, compositions having the polypeptides of the invention and at least one substrate for the polypeptide upon which to react, and methods of producing 4-HB, GBL, 4-HBal, 4-HBCoA, BDO and/or putrescine using a host cell of the invention.

BRIEF DESCRIPTION OF THE DRAWINGS

(FIG. 3A) 4-HB concentration in culture broth; (FIG. 3B) succinate concentration in culture broth; (FIG. 3C) culture OD, measured at 600 nm. Clusters of bars represent the 24 hour, 48 hour, and 72 hour (if measured) timepoints. The codes along the x-axis indicate the strain/plasmid combination used. The first index refers to the host strain: 1, MG1655 lacI$^Q$; 2, MG1655 ΔgabD lacI$^Q$; 3, MG1655 ΔgabD ΔaldAlacI$^Q$. The second index refers to the plasmid combination used: 1, pZE13-0004-0035 and pZA33-0036; 2, pZE13-0004-0035 and pZA33-0010n; 3, pZE13-0004-0008 and pZA33-0036; 4, pZE13-0004-0008 and pZA33-0010n; 5, Control vectors pZE13 and pZA33.

FIGS. 6A and 6B, mass 116 characteristic fragment of derivatized BDO, containing 2 carbon atoms; FIGS. 6C and 6D, mass 177 characteristic fragment of derivatized BDO, containing 1 carbon atom; FIGS. 6E and 6F, mass 117 characteristic fragment of derivatized 4-HB, containing 2 carbon atoms; FIGS. 6G and 6H, mass 233 characteristic fragment of derivatized 4-HB, containing 4 carbon atoms.

FIGS. 8A and 8B show exemplary 1,4-butanediol (BDO) pathways. FIG. 8A shows BDO pathways from succinyl-CoA. FIG. 8B shows BDO pathways from alpha-ketoglutarate.

FIGS. 9A and 9B show pathways from 4-aminobutyrate. FIG. 9C shows a pathway from acetoactyl-CoA to 4-aminobutyrate.

FIG. 11 shows exemplary BDO pathways from glutamate.

FIG. 12 shows exemplary BDO pathways from acetoacetyl-CoA.

FIGS. 14A-14C show the nucleotide and amino acid sequences of E. coli succinyl-CoA synthetase. FIG. 14A shows the nucleotide sequence (SEQ ID NO:46) of the E. coli sucCD operon. FIGS. 14B (SEQ ID NO:47) and 14C (SEQ ID NO:48) show the amino acid sequences of the succinyl-CoA synthetase subunits encoded by the sucCD operon.

FIGS. 15A and 15B show the nucleotide and amino acid sequences of Mycobacterium bovis alpha-ketoglutarate decarboxylase. FIG. 15A shows the nucleotide sequence (SEQ ID NO:49) of Mycobacterium bovis sucA gene. FIG. 15B shows the amino acid sequence (SEQ ID NO:50) of M. bovis alpha-ketoglutarate decarboxylase.

FIG. 18 A shows the nucleotide sequence (SEQ ID NO: 51) of CoA-dependent succinate semialdehyde dehydrogenase (sucD) from Porphyromonas gingivalis, and FIG. 18B shows the encoded amino acid sequence (SEQ ID NO:52).

FIG. 19A shows the nucleotide sequence (SEQ ID NO:53) of 4-hydroxybutyrate dehydrogenase (4hbd) from Porphymonas gingivalis, and FIG. 19B shows the encoded amino acid sequence (SEQ ID NO:54).

FIG. 20A shows the nucleotide sequence (SEQ ID NO:55) of 4-hydroxybutyrate CoA transferase (cat2) from Porphyromonas gingivalis, and FIG. 20B shows the encoded amino acid sequence (SEQ ID NO:56).

FIG. 21A shows the nucleotide sequence (SEQ ID NO:57) of phosphotransbutyrylase (ptb) from Clostridium acetobuylicum, and FIG. 21B shows the encoded amino acid sequence (SEQ ID NO:58).

FIG. 22A shows the nucleotide sequence (SEQ ID NO:59) of butyrate kinase (buk1) from Clostridium acetobuylicum, and FIG. 22B shows the encoded amino acid sequence (SEQ ID NO:60).

FIGS. 23A-23D show alternative nucleotide sequences for C. acetobuylicum 020 (phosphtransbutyrylase) with altered codons for more prevalent E. coli codons relative to the C. acetobuylicum native sequence. FIGS. 23A-23D (020A-020D, SEQ ID NOS:61-64, respectively) contain sequences with increasing numbers of rare E. coli codons replaced by more prevalent codons (A<B<C<D).

FIGS. 24A-24D show alternative nucleotide sequences for C. acetobuytlicum 021 (butyrate kinase) with altered codons for more prevalent E. coli codons relative to the C. acetobuylicum native sequence. FIGS. 24A-24D (021A-021B, SEQ ID NOS:65-68, respectively) contain sequences with increasing numbers of rare E. coli codons replaced by more prevalent codons (A<B<C<D).

FIG. 25A shows sodium dodecyl sulfate polyacrylamide gel electrophoresis (SDS-PAGE) stained for proteins with Coomassie blue; lane 1, control vector with no insert; lane 2, expression of C. acetobutylicum native sequences in E. coli; lane 3, expression of 020B-021B codon optimized PTB-BK; lane 4, expression of 020C-021C codon optimized PTB-BK. The positions of BK and PTB are shown. FIG. 25B shows the BK and PTB activities of native C. acetobuylicum sequence (2021n) compared to codon optimized 020B-021B (2021B) and 020C-021C (2021C).

FIG. 27A shows the nucleotide sequence (SEQ ID NO:69) of the native Clostridium biejerinckii ald gene (025n), and FIG. 27B shows the encoded amino acid sequence (SEQ ID NO:70).

FIGS. 28A-28D show alternative gene sequences for the Clostridium beijerinckii ald gene (025A-025D, SEQ ID NOs: 71-74, respectively), in which increasing numbers of rare codons are replaced by more prevalent codons (A<B<C<D).

FIG. 30A shows BDO production in strains containing the native C. beijerinckii ald gene (025n) or variants with optimized codons for expression in E. coli (025A-025D). FIG. 30B shows production of ethanol and BDO in strains expressing the C. acetobutylicum AdhE2 enzyme (002C) compared to the codon optimized variant 025B. The third set shows expression of P. gingivalis sucD (035). In all cases, P. gingivalis Cat2 (034) is also expressed.

FIG. 31A shows the nucleotide sequence (SEQ ID NO:75) of the adh1 gene from *Geobacillus thermoglucosidasius*, and FIG. 31B shows the encoded amino acid sequence (SEQ ID NO:76).

FIG. 35 shows the sequence (SEQ ID NO:77) of the ECKh-138 region encompassing the aceF and lpdA genes. The *K. pneumonia* lpd4 gene is underlined, and the codon changed in the Glu354Lys mutant shaded.

FIG. 36 shows the protein sequence comparison of the native *E. coli* lpdA (SEQ ID NO: 78) and the mutant *K. pneumonia* lpdA (SEQ ID NO:79).

FIG. 37 shows 4-hydroxybutyrate (left bars) and BDO (right bars) production in the strains AB3, MG1655 ΔldhA and ECKh-138. All strains expressed *E. coli* sucCD, *P. gingivalis* sucD, *P. gingivalis* 4hbd on the medium copy plasmid pZA33, and *P. gingivalis* Cat2, *C. acetobutylicum* AdhE2 on the high copy plasmid pZE13.

FIG. 38 shows the nucleotide sequence (SEQ ID NO:80) of the 5' end of the aceE gene fused to the pflB-p6 promoter and ribosome binding site (RBS). The 5' italicized sequence shows the start of the aroP gene, which is transcribed in the opposite direction from the pdh operon. The 3' italicized sequence shows the start of the aceE gene. In upper case: pflB RBS. Underlined: FNR binding site. In bold: pflB-p6 promoter sequence.

FIG. 39 shows the nucleotide sequence (SEQ ID NO:81) in the aceF-lpdA region in the strain ECKh-456.

FIG. 41B shows the nucleotide sequence of the PCR product (SEQ ID NO:82) and the encoded amino acid sequence (SEQ ID NO:83) of the amplification of chloramphenicol resistance gene (CAT) flanked by FRT sites and homology regions from the mdh gene from the plasmid pKD3.

FIG. 42 shows the sequence (SEQ ID NO:84) of the arcA deleted region in strain ECKh-401.

FIG. 43 shows the sequence (SEQ ID NO:85) of the region encompassing a mutated gltA gene of strain ECKh-422.

FIGS. 44A-44B show the citrate synthase activity of wild type gltA gene product (FIG. 44A) and the R163L mutant (FIG. 44B). The assay was performed in the absence (diamonds) or presence of 0.4 mM NADH (squares).

FIG. 45 shows the 4-hydroxybutyrate (left bars) and BDO (right bars) production in strains ECKh-401 and ECKh-422, both expressing genes for the complete BDO pathway on plasmids.

FIG. 48 shows the sequence (SEQ ID NO:86) of the region following replacement of PEP carboxylase (ppc) by *H. influenzae* phosphoenolpyruvate carboxykinase (pepck). The pepck coding region is underlined.

FIG. 52 shows the nucleotide sequence (SEQ ID NO:87) of the genomic DNA of strain ECKh-426 in the region of insertion of a polycistronic DNA fragment containing a promoter, sucCD gene, sucD gene, 4hbd gene and a terminator sequence.

FIG. 53 shows the nucleotide sequence (SEQ ID NO:88) of the chromosomal region of strain ECKh-432 in the region of insertion of a polycistronic sequence containing a promoter, sucA gene, *C. kluyveri* 4hbd gene and a terminator sequence.

FIG. 55 shows a PCR product (SEQ ID NO:89, top strand, and SEQ ID NO:519, bottom strand) containing the non-phosphotransferase (non-PTS) sucrose utilization genes flanked by regions of homology to the rrnC region.

FIG. 59A shows the nucleotide sequence (SEQ ID NO:90) of carboxylic acid reductase from *Nocarcia iowen-* sis (GNM_720), and FIG. 59B shows the encoded amino acid sequence (SEQ ID NO:91).

FIG. 60A shows the nucleotide sequence (SEQ ID NO:92) of phosphpantetheine transferase, which was codon optimized, and FIG. 60B shows the encoded amino acid sequence (SEQ ID NO:93).

FIGS. 62A and 62B show pathways to 1,4-butanediol from succinate, succcinyl-CoA, and alpha-ketoglutarate. Abbreviations: A) Succinyl-CoA reductase (aldehyde forming), B) Alpha-ketoglutarate decarboxylase, C) 4-Hydroxybutyrate dehydrogenase, D) 4-Hydroxybutyrate reductase, E) 1,4-Butanediol dehydrogenase, F) Succinate reductase, G) Succinyl-CoA transferase, H) Succinyl-CoA hydrolase, I) Succinyl-CoA synthetase (or Succinyl-CoA ligase), J) Glutamate dehydrogenase, K) Glutamate transaminase, L) Glutamate decarboxylase, M) 4-aminobutyrate dehydrogenase, N) 4-aminobutyrate transaminase, O) 4-Hydroxybutyrate kinase, P) Phosphotrans-4-hydroxybutyrylase, Q) 4-Hydroxybutyryl-CoA reductase (aldehyde forming), R) 4-hydroxybutyryl-phosphate reductase, S) Succinyl-CoA reductase (alcohol forming), T) 4-Hydroxybutyryl-CoA transferase, U) 4-Hydroxybutyryl-CoA hydrolase, V) 4-Hydroxybutyryl-CoA synthetase (or 4-Hydroxybutyryl-CoA ligase), W) 4-Hydroxybutyryl-CoA reductase (alcohol forming), X) Alpha-ketoglutarate reductase, Y) 5-Hydroxy-2-oxopentanoate dehydrogenase, Z) 5-Hydroxy-2-oxopentanoate decarboxylase, AA) 5-hydroxy-2-oxopentanoate dehydrogenase (decarboxylation).

FIG. 64A shows the nucleotide sequence (SEQ ID NO:94) of carboxylic acid reductase from *Mycobacterium smegmatis* mc(2)155 (designated 890), and FIG. 64B shows the encoded amino acid sequence (SEQ ID NO:95).

FIG. 65A shows the nucleotide sequence (SEQ ID NO:96) of carboxylic acid reductase from *Mycobacterium avium* subspecies *paratuberculosis* K-10 (designated 891), and FIG. 65B shows the encoded amino acid sequence (SEQ ID NO:97).

FIG. 66A shows the nucleotide sequence (SEQ ID NO:98) of carboxylic acid reductase from *Mycobacterium marinum* M (designated 892), and FIG. 66B shows the encoded amino acid sequence (SEQ ID NO:99).

FIG. 67 shows a schematic of the *E. coli* MG1655 chromosome between nucleotides 760928 and 765930.

FIGS. 68A-68E show a schematic of the sequences and oligonucleotides used in the construction of the sucCD deletion.

FIG. 89A shows the nucleotide sequence of the *Yersinia* gene (locus yinte0001_13710) (SEQ ID NO: 177), and FIG. 89B shows the encoded amino acid sequence (SEQ ID NO: 179).

FIG. 90A shows the nucleotide sequence of the gene from *Agrobacterium tumefaciens* (SEQ ID NO: 178), and FIG. 90B shows the encoded amino acid sequence (SEQ ID NO: 180).

DETAILED DESCRIPTION OF THE INVENTION

Figure 1:
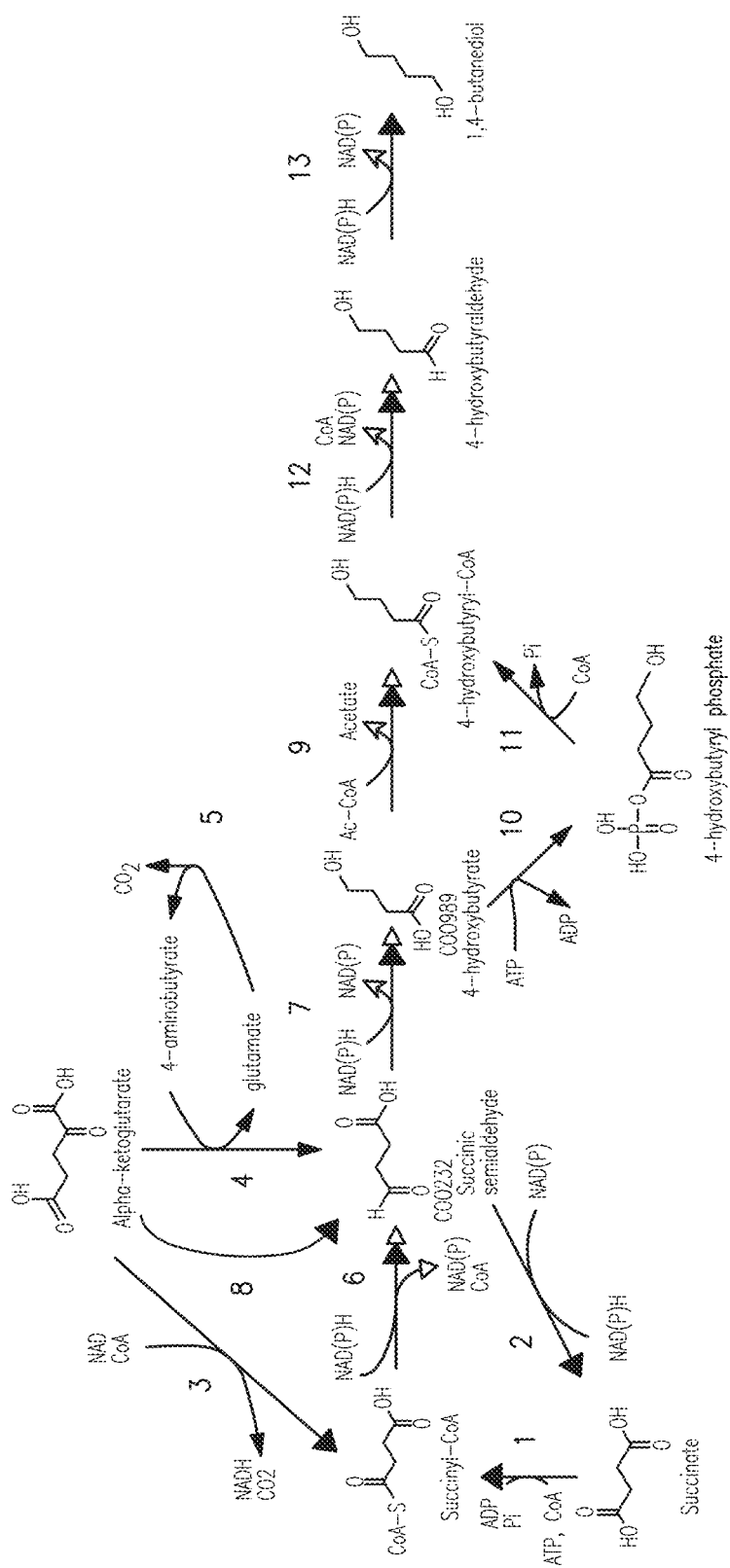
FIG. 1 is a schematic diagram showing biochemical pathways to 4-hydroxybutyurate (4-HB) and to 1,4-butanediol production. The first 5 steps are endogenous to *E. coli*, while the remainder can be expressed heterologously. Enzymes catalyzing the biosynthetic reactions are: (1) succinyl-CoA synthetase; (2) CoA-independent succinic semialdehyde dehydrogenase; (3) α-ketoglutarate dehydrogenase; (4) glutamate:succinate semialdehyde transaminase; (5) glutamate decarboxylase; (6) CoA-dependent succinic semialdehyde dehydrogenase; (7) 4-hydroxybutanoate dehydrogenase; (8) α-ketoglutarate decarboxylase; (9) 4-hydroxybutyryl CoA:acetyl-CoA transferase; (10) butyrate kinase; (11) phosphotransbutyrylase; (12) aldehyde dehydrogenase; (13) alcohol dehydrogenase.

The present invention is directed to the design and production of cells and organisms having biosynthetic production capabilities for 4-hydroxybutanoic acid (4-hydroxybutyrate, 4-HB), γ-butyrolactone, 1,4-butanediol (BDO), 4-hydroxybutanal (4-hydroxybutyraldehyde, 4-HBal), 4-hydroxybutyryl-CoA (4-HBCoA) and/or putrescine. The invention, in particular, relates to the design of microbial organisms capable of producing BDO, 4-HBal, 4-HBCoA and/or putrescine by introducing one or more nucleic acids encoding a BDO, 4-HBal, 4-HBCoA and/or putrescine pathway enzyme.

In one embodiment, the invention utilizes in silico stoichiometric models of *Escherichia coli* metabolism that identify metabolic designs for biosynthetic production of 4-hydroxybutanoic acid (4-HB), 1,4-butanediol (BDO), 4-HBal, 4-HBCoA and/or putrescine. The results described herein indicate that metabolic pathways can be designed and recombinantly engineered to achieve the biosynthesis of 4-HBal, 4-HBCoA or 4-HB and downstream products such as 1,4-butanediol or putrescine in *Escherichia coli* and other cells or organisms. Biosynthetic production of 4-HB, 4-HBal, 4-HBCoA, BDO and/or putrescine, for example, for the in silico designs can be confirmed by construction of strains having the designed metabolic genotype. These metabolically engineered cells or organisms also can be subjected to adaptive evolution to further augment 4-HB, 4-HBal, 4-HBCoA, BDO and/or putrescine biosynthesis, including under conditions approaching theoretical maximum growth.

In certain embodiments, the 4-HB, 4-HBal, 4-HBCoA, BDO and/or putrescine biosynthesis characteristics of the designed strains make them genetically stable and particularly useful in continuous bioprocesses. Separate strain design strategies were identified with incorporation of different non-native or heterologous reaction capabilities into *E. coli* or other host organisms leading to 4-HB and 1,4-butanediol producing metabolic pathways from either CoA-independent succinic semialdehyde dehydrogenase, succinyl-CoA synthetase and CoA-dependent succinic semialdehyde dehydrogenase, or glutamate:succinic semialdehyde transaminase. In silico metabolic designs were identified that resulted in the biosynthesis of 4-HB in both *E. coli* and yeast species from each of these metabolic pathways. The 1,4-butanediol intermediate γ-butyrolactone can be generated in culture by spontaneous cyclization under conditions at pH<7.5, particularly under acidic conditions, such as below pH 5.5, for example, pH<7, pH<6.5, pH<6, and particularly at pH<5.5 or lower.

Strains identified via the computational component of the platform can be put into actual production by genetically engineering any of the predicted metabolic alterations which lead to the biosynthetic production of 4-HB, 1,4-butanediol or other intermediate and/or downstream products. In yet a further embodiment, strains exhibiting biosynthetic production of these compounds can be further subjected to adaptive evolution to further augment product biosynthesis. The levels of product biosynthesis yield following adaptive evolution also can be predicted by the computational component of the system.

In other specific embodiments, microbial organisms were constructed to express a 4-HB biosynthetic pathway encoding the enzymatic steps from succinate to 4-HB and to 4-HB-CoA. Co-expression of succinate coenzyme A transferase, CoA-dependent succinic semialdehyde dehydrogenase, NAD-dependent 4-hydroxybutyrate dehydrogenase and 4-hydroxybutyrate coenzyme A transferase in a host microbial organism resulted in significant production of 4-HB compared to host microbial organisms lacking a 4-HB biosynthetic pathway. In a further specific embodiment, 4-HB-producing microbial organisms were generated that utilized α-ketoglutarate as a substrate by introducing nucleic acids encoding α-ketoglutarate decarboxylase and NAD-dependent 4-hydroxybutyrate dehydrogenase.

In another specific embodiment, microbial organisms containing a 1,4-butanediol (BDO) biosynthetic pathway were constructed that biosynthesized BDO when cultured in the presence of 4-HB. The BDO biosynthetic pathway consisted of a nucleic acid encoding either a multifunctional aldehyde/alcohol dehydrogenase or nucleic acids encoding an aldehyde dehydrogenawse and an alcohol dehydrogenase. To support growth on 4-HB substrates, these BDO-producing microbial organisms also expressed 4-hydroxybutyrate CoA transferase or 4-butyrate kinase in conjunction with phosphotranshydroxybutyrlase. In yet a further specific embodiment, microbial organisms were generated that synthesized BDO through exogenous expression of nucleic acids encoding a functional 4-HB biosynthetic pathway and a functional BDO biosynthetic pathway. The 4-HB biosynthetic pathway consisted of succinate coenzyme A transferase, CoA-dependent succinic semialdehyde dehydrogenase, NAD-dependent 4-hydroxybutyrate dehydrogenase and 4-hydroxybutyrate coenzyme A transferase. The BDO pathway consisted of a multifunctional aldehyde/alcohol dehydrogenase. Further described herein are additional pathways for production of BDO (see FIGS. 8-13).

In a further embodiment, described herein is the cloning and expression of a carboxylic acid reductase enzyme that functions in a 4-hydroxybutanal, 4-hydroxybutyryl-CoA or 1,4-butanediol metabolic pathway. Advantages of employing a carboxylic acid reductase as opposed to an acyl-CoA reductase to form 4-hydroxybutyraldehyde (4-hydroxybutanal) include lower ethanol and GBL byproduct formation accompanying the production of BDO. Also disclosed herein is the application of carboxylic acid reductase as part of additional numerous pathways to produce 1,4-butanediol and putrescine from the tricarboxylic acid (TCA) cycle metabolites, for example, succinate, succinyl-CoA, and/or alpha-ketoglutarate.

As used herein, the term "non-naturally occurring" when used in reference to a microbial organism or microorganism of the invention is intended to mean that the microbial organism has at least one genetic alteration not normally found in a naturally occurring strain of the referenced species, including wild-type strains of the referenced species. Genetic alterations include, for example, modifications introducing expressible nucleic acids encoding metabolic polypeptides, other nucleic acid additions, nucleic acid deletions and/or other functional disruption of the microbial organism's genetic material. Such modifications include, for example, coding regions and functional fragments thereof, for heterologous, homologous or both heterologous and homologous polypeptides for the referenced species. Additional modifications include, for example, non-coding regulatory regions in which the modifications alter expression of a gene or operon. Exemplary metabolic polypeptides include enzymes or proteins within a biosynthetic pathway for a 4-HB, 4-HBal, 4-HBCoA, BDO or putrescine family of compounds.

A metabolic modification refers to a biochemical reaction that is altered from its naturally occurring state. Therefore, non-naturally occurring microorganisms can have genetic modifications to nucleic acids encoding metabolic polypeptides or, functional fragments thereof. Exemplary metabolic modifications are disclosed herein.

As used herein, the term "isolated" when used in reference to a microbial organism is intended to mean an organism that is substantially free of at least one component as the referenced microbial organism is found in nature. The term includes a microbial organism that is removed from some or all components as it is found in its natural environment. The term also includes a microbial organism that is removed from some or all components as the microbial organism is found in non-naturally occurring environments. Therefore, an isolated microbial organism is partly or completely separated from other substances as it is found in nature or as it is grown, stored or subsisted in non-naturally occurring environments. Specific examples of isolated microbial organisms include partially pure microbes, substantially pure microbes and microbes cultured in a medium that is non-naturally occurring.

As used herein, the terms "microbial," "microbial organism" or "microorganism" are intended to mean any organism that exists as a microscopic cell that is included within the domains of archaea, bacteria or eukarya. Therefore, the term is intended to encompass prokaryotic or eukaryotic cells or organisms having a microscopic size and includes bacteria, archaea and eubacteria of all species as well as eukaryotic microorganisms such as yeast and fungi. The term also includes cell cultures of any species that can be cultured for the production of a biochemical.

As used herein, the term "4-hydroxybutanoic acid" is intended to mean a 4-hydroxy derivative of butyric acid having the chemical formula $C_4H_8O_3$ and a molecular mass of 104.11 g/mol (126.09 g/mol for its sodium salt). The chemical compound 4-hydroxybutanoic acid also is known in the art as 4-HB, 4-hydroxybutyrate, gamma-hydroxybutyric acid or GHB. The term as it is used herein is intended to include any of the compound's various salt forms and include, for example, 4-hydroxybutanoate and 4-hydroxybutyrate. Specific examples of salt forms for 4-HB include sodium 4-HB and potassium 4-HB. Therefore, the terms 4-hydroxybutanoic acid, 4-HB, 4-hydroxybutyrate, 4-hydroxybutanoate, gamma-hydroxybutyric acid and GHB as well as other art recognized names are used synonymously herein.

As used herein, the term "monomeric" when used in reference to 4-HB is intended to mean 4-HB in a non-polymeric or underivatized form. Specific examples of polymeric 4-HB include poly-4-hydroxybutanoic acid and copolymers of, for example, 4-HB and 3-HB. A specific example of a derivatized form of 4-HB is 4-HB-CoA. Other polymeric 4-HB forms and other derivatized forms of 4-HB also are known in the art.

As used herein, the term "γ-butyrolactone" is intended to mean a lactone having the chemical formula $C_4H_6O_2$ and a molecular mass of 86.089 g/mol. The chemical compound γ-butyrolactone also is know in the art as GBL, butyrolactone, 1,4-lactone, 4-butyrolactone, 4-hydroxybutyric acid lactone, and gamma-hydroxybutyric acid lactone. The term as it is used herein is intended to include any of the compound's various salt forms.

As used herein, the term "1,4-butanediol" is intended to mean an alcohol derivative of the alkane butane, carrying two hydroxyl groups which has the chemical formula $C_4H_{10}O_2$ and a molecular mass of 90.12 g/mol. The chemical compound 1,4-butanediol also is known in the art as BDO and is a chemical intermediate or precursor for a family of compounds referred to herein as BDO family of compounds.

As used herein, the term "4-hydroxybutanal" is intended to mean an aledehyde having the chemical formula $C_4H_8O_2$ and a molecular mass of 88.10512 g/mol. The chemical compound 4-hydroxybutanal (4-HBal) is also known in the art as 4-hydroxybutyraldehyde.

As used herein, the term "putrescine" is intended to mean a diamine having the chemical formula $C_4H_{12}N_2$ and a molecular mass of 88.15148 g/mol. The chemical compound putrescine is also known in the art as 1,4-butanediamine, 1,4-diaminobutane, butylenediamine, tetramethylenediamine, tetramethyldiamine, and 1,4-butylenediamine.

As used herein, the term "tetrahydrofuran" is intended to mean a heterocyclic organic compound corresponding to the fully hydrogenated analog of the aromatic compound furan which has the chemical formula $C_4H_8O$ and a molecular mass of 72.11 g/mol. The chemical compound tetrahydrofuran also is known in the art as THF, tetrahydrofuran, 1,4-epoxybutane, butylene oxide, cyclotetramethylene oxide, oxacyclopentane, diethylene oxide, oxolane, furanidine, hydrofuran, tetra-methylene oxide. The term as it is used herein is intended to include any of the compound's various salt forms.

As used herein, the term "CoA" or "coenzyme A" is intended to mean an organic cofactor or prosthetic group (nonprotein portion of an enzyme) whose presence is required for the activity of many enzymes (the apoenzyme) to form an active enzyme system. Coenzyme A functions in certain condensing enzymes, acts in acetyl or other acyl group transfer and in fatty acid synthesis and oxidation, pyruvate oxidation and in other acetylation.

As used herein, the term "substantially anaerobic" when used in reference to a culture or growth condition is intended to mean that the amount of oxygen is less than about 10% of saturation for dissolved oxygen in liquid media. The term also is intended to include sealed chambers of liquid or solid medium maintained with an atmosphere of less than about 1% oxygen.

The non-naturally occurring microbal organisms of the invention can contain stable genetic alterations, which refers to microorganisms that can be cultured for greater than five generations without loss of the alteration. Generally, stable genetic alterations include modifications that persist greater than 10 generations, particularly stable modifications will persist more than about 25 generations, and more particularly, stable genetic modifications will be greater than 50 generations, including indefinitely.

In the case of gene disruptions, a particularly useful stable genetic alteration is a gene deletion. The use of a gene deletion to introduce a stable genetic alteration is particularly useful to reduce the likelihood of a reversion to a phenotype prior to the genetic alteration. For example, if desired, stable growth-coupled production of a biochemical can be achieved, for example, by deletion of a gene encoding an enzyme catalyzing one or more reactions within a set of metabolic modifications. The stability of growth-coupled production of a biochemical can be further enhanced through multiple deletions, significantly reducing the likelihood of multiple compensatory reversions occurring for each disrupted activity.

Those skilled in the art will understand that the genetic alterations, including metabolic modifications exemplified herein are described with reference to a suitable source or host organism such as *E. coli*, yeast, or other organisms disclosed herein and their corresponding metabolic reactions or a suitable source organism for desired genetic material such as genes encoding enzymes for their corresponding metabolic reactions for a desired metabolic pathway. However, given the complete genome sequencing of a wide variety of organisms and the high level of skill in the area of genomics, those skilled in the art will readily be able to apply the teachings and guidance provided herein to essentially all other organisms. For example, the *E. coli* metabolic alterations exemplified herein can readily be applied to other species by incorporating the same or analogous encoding nucleic acid from species other than the referenced species. Such genetic alterations include, for example, genetic alterations of species homologs, in general, and in particular, orthologs, paralogs or nonorthologous gene displacements.

An ortholog is a gene or genes that are related by vertical descent and are responsible for substantially the same or identical functions in different organisms. For example, mouse epoxide hydrolase and human epoxide hydrolase can be considered orthologs for the biological function of hydrolysis of epoxides. Genes are related by vertical descent when, for example, they share sequence similarity of sufficient amount to indicate they are homologous, or related by evolution from a common ancestor. Genes can also be considered orthologs if they share three-dimensional structure but not necessarily sequence similarity, of a sufficient amount to indicate that they have evolved from a common ancestor to the extent that the primary sequence similarity is not identifiable. Genes that are orthologous can encode proteins with sequence similarity of about 25% to 100% amino acid sequence identity. Genes encoding proteins sharing an amino acid similarity less that 25% can also be considered to have arisen by vertical descent if their three-dimensional structure also shows similarities. Members of the serine protease family of enzymes, including tissue plasminogen activator and elastase, are considered to have arisen by vertical descent from a common ancestor.

Orthologs include genes or their encoded gene products that through, for example, evolution, have diverged in structure or overall activity. For example, where one species encodes a gene product exhibiting two functions and where such functions have been separated into distinct genes in a second species, the three genes and their corresponding products are considered to be orthologs. For the production, including growth-coupled production, of a biochemical product, those skilled in the art will understand that the orthologous gene harboring the metabolic activity to be introduced or disrupted is to be chosen for construction of the non-naturally occurring microorganism. An example of orthologs exhibiting separable activities is where distinct activities have been separated into distinct gene products between two or more species or within a single species. A specific example is the separation of elastase proteolysis and plasminogen proteolysis, two types of serine protease activity, into distinct molecules as plasminogen activator and elastase. A second example is the separation of mycoplasma 5'-3' exonuclease and *Drosophila* DNA polymerase III activity. The DNA polymerase from the first species can be considered an ortholog to either or both of the exonuclease or the polymerase from the second species and vice versa.

In contrast, paralogs are homologs related by, for example, duplication followed by evolutionary divergence and have similar or common, but not identical functions. Paralogs can originate or derive from, for example, the same species or from a different species. For example, microsomal epoxide hydrolase (epoxide hydrolase I) and soluble epoxide hydrolase (epoxide hydrolase II) can be considered paralogs because they represent two distinct enzymes, co-evolved from a common ancestor, that catalyze distinct reactions and have distinct functions in the same species. Paralogs are proteins from the same species with significant sequence similarity to each other suggesting that they are homologous, or related through co-evolution from a common ancestor. Groups of paralogous protein families include HipA homologs, luciferase genes, peptidases, and others.

A nonorthologous gene displacement is a nonorthologous gene from one species that can substitute for a referenced gene function in a different species. Substitution includes, for example, being able to perform substantially the same or a similar function in the species of origin compared to the referenced function in the different species. Although generally, a nonorthologous gene displacement will be identifiable as structurally related to a known gene encoding the referenced function, less structurally related but functionally similar genes and their corresponding gene products nevertheless will still fall within the meaning of the term as it is used herein. Functional similarity requires, for example, at least some structural similarity in the active site or binding region of a nonorthologous gene product compared to a gene encoding the function sought to be substituted. Therefore, a nonorthologous gene includes, for example, a paralog or an unrelated gene.

Therefore, in identifying and constructing the non-naturally occurring microbial organisms of the invention having 4-HB, GBL, 4-HBal, 4-HBCoA, BDO and/or putrescine biosynthetic capability, those skilled in the art will understand with applying the teaching and guidance provided herein to a particular species that the identification of metabolic modifications can include identification and inclusion or inactivation of orthologs. To the extent that paralogs and/or nonorthologous gene displacements are present in the referenced microorganism that encode an enzyme catalyzing a similar or substantially similar metabolic reaction, those skilled in the art also can utilize these evolutionarily related genes. Similarly for a gene disruption, evolutionarily related genes can also be disrupted or deleted in a host microbial organism to reduce or eliminate functional redundancy of enzymatic activities targeted for disruption.

Orthologs, paralogs and nonorthologous gene displacements can be determined by methods well known to those skilled in the art. For example, inspection of nucleic acid or amino acid sequences for two polypeptides will reveal sequence identity and similarities between the compared sequences. Based on such similarities, one skilled in the art can determine if the similarity is sufficiently high to indicate the proteins are related through evolution from a common ancestor. Algorithms well known to those skilled in the art, such as Align, BLAST, Clustal W and others compare and determine a raw sequence similarity or identity, and also determine the presence or significance of gaps in the sequence which can be assigned a weight or score. Such algorithms also are known in the art and are similarly applicable for determining nucleotide sequence similarity or identity. Parameters for sufficient similarity to determine relatedness are computed based on well known methods for calculating statistical similarity, or the chance of finding a similar match in a random polypeptide, and the significance of the match determined. A computer comparison of two or more sequences can, if desired, also be optimized visually by those skilled in the art. Related gene products or proteins can be expected to have a high similarity, for example, 25% to 100% sequence identity. Proteins that are unrelated can have an identity which is essentially the same as would be expected to occur by chance, if a database of sufficient size is scanned (about 5%). Sequences between 5% and 24% may or may not represent sufficient homology to conclude that the compared sequences are related. Additional statistical analysis to determine the significance of such matches given the size of the data set can be carried out to determine the relevance of these sequences.

Exemplary parameters for determining relatedness of two or more sequences using the BLAST algorithm, for example, can be as set forth below. Briefly, amino acid sequence alignments can be performed using BLASTP version 2.0.8 (Jan. 5, 1999) and the following parameters: Matrix: 0 BLOSUM62; gap open: 11; gap extension: 1; x_dropoff: 50; expect: 10.0; wordsize: 3; filter: on. Nucleic acid sequence alignments can be performed using BLASTN version 2.0.6 (Sep. 16, 1998) and the following parameters: Match: 1; mismatch: −2; gap open: 5; gap extension: 2; x_dropoff: 50; expect: 10.0; wordsize: 11; filter: off. Those skilled in the art will know what modifications can be made to the above parameters to either increase or decrease the stringency of the comparison, for example, and determine the relatedness of two or more sequences.

"Conservative amino acid substitution" or, simply, "conservative variations" of a particular sequence refers to the replacement of one amino acid, or series of amino acids, with essentially identical amino acid sequences. One of skill will recognize that individual substitutions, deletions or additions that alter, add or delete a single amino acid or a percentage of amino acids in an encoded sequence result in "conservative variations" where the alterations result in the deletion of an amino acid, addition of an amino acid, or substitution of an amino acid with a functionally similar amino acid. One of skill in the art will also recognize that an individual substitution, deletion or addition disclosed herein that refers to a specific variant, e.g. substitution of a Glycine a residue 34 with a Histidine (G34H), can include a conservative substitution made at the same residue as disclosed herein, e.g. instead of a Histindine being substituted at residue 34, an Arginine (R) or a Lysine (K) can be substituted.

Conservative substitution tables providing functionally similar amino acids are well known in the art. Conservative amino acid substitutions includes replacement of one amino acid with another having the same type of functional group or side chain polarity, size, shape or charge (e.g., aliphatic, aromatic, positively charged, negatively charged, polar, non-polar, positive polar, negative polar, uncharged polar, non-polar hydrophobic, ionizable acidic, ionizable basic, or sulfur containing residues).

As a non-limiting example, the following six groups each contain amino acids that can be conservative substitutions for one another:
 1) Alanine (A), Serine (S), Threonine (T);
 2) Aspartic acid (D), Glutamic acid (E);
 3) Asparagine (N), Glutamine (Q);
 4) Arginine (R), Lysine (K); Histidine (H);
 5) Isoleucine (I), Leucine (L), Methionine (M), Valine (V); and
 6) Phenylalanine (F), Tyrosine (Y), Tryptophan (W).

Thus, conservative amino acid substitutions of a polypeptide sequence disclosed herein can include substitutions of a percentage, such as less than 1%, 5% or 10%, of the amino acids of the polypeptide sequence, with a conservatively selected amino acid of the same conservative substitution group. Additionally, a conservatively substituted variation of a polypeptide sequence disclosed herein can contain no more than 1, 2, 3, 4, 5, 10, 20, 30, 50, or 100 substitutions with a conservatively substituted variation of the same conservative substitution group.

It is also understood that the addition or substitution of nucleic acid sequences which do not alter the encoded polypeptide activity of a nucleic acid molecule, such as the addition of a non-functional or non-coding sequence, is a conservative variation of the nucleic acid sequence. One of skill in the art will appreciate that many conservative variations of the nucleic acid molecules disclosed yield a functionally identical polypeptide. For example, owing to the degeneracy of the genetic code, silent substitutions (i.e., substitutions in a nucleic acid sequence which do not result in an alteration in an encoded polypeptide) are an implied feature of every nucleic acid sequence which encodes an amino acid. Similarly, conservative amino acid substitutions, in one or more amino acids in an amino acid sequence can be substituted with different amino acids with highly similar properties, are also readily identified as being highly similar to a disclosed construct. Such conservative variations of each disclosed sequence are a feature of the polypeptides disclosed herein.

Non-conservative modifications of a particular polypeptide are those which substitute any amino acid not characterized as a conservative substitution. For example, any substitution which crosses the bounds of the six groups set forth above. These include substitutions of basic or acidic amino acids for neutral amino acids (e.g., Aspartic acid (D), Glutamic acid (E), Asparagine (N), or Glutamine (Q) for Valine (V), Isoleucine (I), Leucine (L) or Methionine (M)), aromatic amino acid for basic or acidic amino acids (e.g., Phenylalanine (F), Tyrosine (Y) or Tryptophan (W) for Aspartic acid (D), Asparagine (N), Glutamic acid (E) or Glutamine (Q)), or any other substitution not replacing an amino acid with a like amino acid.

Disclosed herein are non-naturally occurring microbial biocatalyst or microbial organisms including a microbial organism having a 4-hydroxybutanoic acid (4-HB) biosynthetic pathway that includes at least one exogenous nucleic acid encoding 4-hydroxybutanoate dehydrogenase, CoA-independent succinic semialdehyde dehydrogenase, succinyl-CoA synthetase, CoA-dependent succinic semialdehyde dehydrogenase, glutamate:succinic semialdehyde transaminase, alpha-ketoglutarate decarboxylase, or glutamate decarboxylase, wherein the exogenous nucleic acid is expressed in sufficient amounts to produce monomeric 4-hydroxybutanoic acid (4-HB). 4-hydroxybutanoate dehydrogenase is also referred to as 4-hydroxybutyrate dehydrogenase or 4-HB dehydrogenase. Succinyl-CoA synthetase is also referred to as succinyl-CoA synthase or succinyl-CoA ligase.

Also disclosed herein is a non-naturally occurring microbial biocatalyst or microbial organism including a microbial organism having a 4-hydroxybutanoic acid (4-HB) biosynthetic pathway having at least one exogenous nucleic acid encoding 4-hydroxybutanoate dehydrogenase, succinyl-CoA synthetase, CoA-dependent succinic semialdehyde dehydrogenase, or α-ketoglutarate decarboxylase, wherein the exogenous nucleic acid is expressed in sufficient amounts to produce monomeric 4-hydroxybutanoic acid (4-HB).

The non-naturally occurring microbial biocatalysts or microbial organisms can include microbial organisms that employ combinations of metabolic reactions for biosynthetically producing the compounds of the invention. The biosynthesized compounds can be produced intracellularly and/or secreted into the culture medium. Exemplary compounds produced by the non-naturally occurring microorganisms include, for example, 4-hydroxybutanoic acid, 1,4-butanediol and γ-butyrolactone.

In one embodiment, a non-naturally occurring microbial organism is engineered to produce 4-HB. This compound is one useful entry point into the 1,4-butanediol family of compounds. The biochemical reactions for formation of 4-HB from succinate, from succinate through succinyl-CoA or from α-ketoglutarate are shown in steps 1-8 of FIG. 1.

It is understood that any combination of appropriate enzymes of a BDO, 4-HB, 4-HBal, 4-HBCoA and/or putrescine pathway can be used so long as conversion from a starting component to the BDO, 4-HBal, 4-HBCoA and/or putrescine product is achieved. Thus, it is understood that any of the metabolic pathways disclosed herein can be utilized and that it is well understood to those skilled in the art how to select appropriate enzymes to achieve a desired pathway, as disclosed herein.

In another embodiment, disclosed herein is a non-naturally occurring microbial organism, comprising a microbial organism having a 1,4-butanediol (BDO) pathway comprising at least one exogenous nucleic acid encoding a BDO pathway enzyme expressed in a sufficient amount to produce BDO, the BDO pathway comprising 4-aminobutyrate CoA transferase, 4-aminobutyryl-CoA hydrolase, 4-aminobutyrate-CoA ligase, 4-aminobutyryl-CoA oxidoreductase (deaminating), 4-aminobutyryl-CoA transaminase, or 4-hydroxybutyryl-CoA dehydrogenase (see Example VII; see corresponding Example and Table 17 in WO2013/184602). The BDO pathway further can comprise 4-hydroxybutyryl-CoA reductase (alcohol forming), 4-hydroxybutyryl-CoA reductase, or 1,4-butanediol dehydrogenase.

It is understood by those skilled in the art that various combinations of the pathways can be utilized, as disclosed herein. For example, in a non-naturally occurring microbial organism, the nucleic acids can encode 4-aminobutyrate CoA transferase, 4-aminobutyryl-CoA hydrolase, or 4-aminobutyrate-CoA ligase; 4-aminobutyryl-CoA oxidoreductase (deaminating) or 4-aminobutyryl-CoA transaminase; and 4-hydroxybutyryl-CoA dehydrogenase. Other exemplary combinations are specifically describe below and further can be found in FIGS. 8-13. For example, the BDO pathway can further comprise 4-hydroxybutyryl-CoA reductase (alcohol forming), 4-hydroxybutyryl-CoA reductase, or 1,4-butanediol dehydrogenase.

Additionally disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising 4-aminobutyrate CoA transferase, 4-aminobutyryl-CoA hydrolase, 4-aminobutyrate-CoA ligase, 4-aminobutyryl-CoA reductase (alcohol forming), 4-aminobutyryl-CoA reductase, 4-aminobutan-1-ol dehydrogenase, 4-aminobutan-1-ol oxidoreductase (deaminating) or 4-aminobutan-1-ol transaminase (see Example VII; see corresponding Example and Table 18 in WO2013/184602), and can further comprise 1,4-butanediol dehydrogenase. For example, the exogenous nucleic acids can encode 4-aminobutyrate CoA transferase, 4-aminobutyryl-CoA hydrolase, or 4-aminobutyrate-CoA ligase; 4-aminobutyryl-CoA reductase (alcohol forming); and 4-aminobutan-1-ol oxidoreductase (deaminating) or 4-aminobutan-1-ol transaminase. In addition, the nucleic acids can encode. 4-aminobutyrate CoA transferase, 4-aminobutyryl-CoA hydrolase, or 4-aminobutyrate-CoA ligase; 4-aminobutyryl-CoA reductase; 4-aminobutan-1-ol dehydrogenase; and 4-aminobutan-1-ol oxidoreductase (deaminating) or 4-aminobutan-1-ol transaminase.

Also disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising 4-aminobutyrate kinase, 4-aminobutyraldehyde dehydrogenase (phosphorylating), 4-aminobutan-1-ol dehydrogenase, 4-aminobutan-1-ol oxidoreductase (deaminating), 4-aminobutan-1-ol transaminase, [(4-aminobutanolyl)oxy]phosphonic acid oxidoreductase (deaminating), [(4-aminobutanolyl)oxy]phosphonic acid transaminase, 4-hydroxybutyryl-phosphate dehydrogenase, or 4-hydroxybutyraldehyde dehydrogenase (phosphorylating) (see Example VII; see corresponding Example and Table 19 in WO2013/184602). For example, the exogenous nucleic acids can encode 4-aminobutyrate kinase; 4-aminobutyraldehyde dehydrogenase (phosphorylating); 4-aminobutan-1-ol dehydrogenase; and 4-aminobutan-1-ol oxidoreductase (deaminating) or 4-aminobutan-1-ol transaminase. Alternatively, the exogenous nucleic acids can encode 4-aminobutyrate kinase; [(4-aminobutanolyl)oxy]phosphonic acid oxidoreductase (deaminating) or [(4-aminobutanolyl)oxy] phosphonic acid transaminase; 4-hydroxybutyryl-phosphate dehydrogenase; and 4-hydroxybutyraldehyde dehydrogenase (phosphorylating).

Additionally disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising alpha-ketoglutarate 5-kinase, 2,5-dioxopentanoic semialdehyde dehydrogenase (phosphorylating), 2,5-dioxopentanoic acid reductase, alpha-ketoglutarate CoA transferase, alpha-ketoglutaryl-CoA hydrolase, alpha-ketoglutaryl-CoA ligase, alpha-ketoglutaryl-CoA reductase, 5-hydroxy-2-oxopentanoic acid dehydrogenase, alpha-ketoglutaryl-CoA reductase (alcohol forming), 5-hydroxy-2-oxopentanoic acid decarboxylase, or 5-hydroxy-2-oxopentanoic acid dehydrogenase (decarboxylation) (see Example VIII; see corresponding Example and Table 20 in WO2013/184602). The BDO pathway can further comprise 4-hydroxybutyryl-CoA reductase (alcohol forming), 4-hydroxybutyryl-CoA reductase, or 1,4-butanediol dehydrogenase.

Further disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising glutamate CoA transferase, glutamyl-CoA hydrolase, glutamyl-CoA ligase, glutamate 5-kinase, glutamate-5-semialdehyde dehydrogenase (phosphorylating), glutamyl-CoA reductase, glutamate-5-semialdehyde reductase, glutamyl-CoA reductase (alcohol forming), 2-amino-5-hydroxypentanoic acid oxidoreductase (deaminating), 2-amino-5-hydroxypentanoic acid transaminase, 5-hydroxy-2-oxopentanoic acid decarboxylase, 5-hydroxy-2-oxopentanoic acid dehydrogenase (decarboxylation) (see Example IX see corresponding Example and Table 21 in WO2013/184602).

Also disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising 3-hydroxybutyryl-CoA dehydrogenase, 3-hydroxybutyryl-CoA dehydratase, vinylacetyl-CoA Δ-isomerase, or 4-hydroxybutyryl-CoA dehydratase (see Example X; see corresponding Example and Table 22 in WO2013/184602). For example, the exogenous nucleic acids can encode 3-hydroxybutyryl-CoA dehydrogenase; 3-hydroxybutyryl-CoA dehydratase; vinylacetyl-CoA Δ-isomerase; and 4-hydroxybutyryl-CoA dehydratase.

Further disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising homoserine deaminase, homoserine CoA transferase, homoserine-CoA hydrolase, homoserine-CoA ligase, homoserine-CoA deaminase, 4-hydroxybut-2-enoyl-CoA transferase, 4-hydroxybut-2-enoyl-CoA hydrolase, 4-hydroxybut-2-enoyl-CoA ligase, 4-hydroxybut-2-enoate reductase, 4-hydroxybutyryl-CoA transferase, 4-hydroxybutyryl-CoA hydrolase, 4-hydroxybutyryl-CoA ligase, or 4-hydroxybut-2-enoyl-CoA reductase (see Example XI; see corresponding Example and Table 23 in WO2013/184602).

Further disclosed herein is a non-naturally occurring microbial organism, comprising a microbial organism having a BDO pathway comprising at least one exogenous nucleic acid encoding a BDO pathway enzyme expressed in a sufficient amount to produce BOD, the BDO pathway comprising succinyl-CoA reductase (alcohol forming), 4-hydroxybutyryl-CoA hydrolase, 4-hydroxybutyryl-CoA ligase, 4-hydroxybutanal dehydrogenase (phosphorylating) (see Table 15). Such a BDO pathway can further comprise succinyl-CoA reductase, 4-hydroxybutyrate dehydrogenase, 4-hydroxybutyryl-CoA transferase, 4-hydroxybutyrate kinase, phosphotrans-4-hydroxybutyrylase, 4-hydroxybutyryl-CoA reductase, 4-hydroxybutyryl-CoA reductase (alcohol forming), or 1,4-butanediol dehydrogenase.

Additionally disclosed herein is a non-naturally occurring microbial organism, comprising a microbial organism having a BDO pathway comprising at least one exogenous nucleic acid encoding a BDO pathway enzyme expressed in a sufficient amount to produce BDO, the BDO pathway comprising glutamate dehydrogenase, 4-aminobutyrate oxidoreductase (deaminating), 4-aminobutyrate transaminase, glutamate decarboxylase, 4-hydroxybutyryl-CoA hydrolase, 4-hydroxybutyryl-CoA ligase, 4-hydroxybutanal dehydrogenase (phosphorylating)(see Table 16). Such a BDO pathway can further comprise alpha-ketoglutarate decarboxylase, 4-hydroxybutyrate dehydrogenase, 4-hydroxybutyryl-CoA transferase, 4-hydroxybutyrate kinase, phosphotrans-4-hydroxybutyrylase, 4-hydroxybutyryl-CoA reductase, 4-hydroxybutyryl-CoA reductase (alcohol forming), or 1,4-butanediol dehydrogenase.

The pathways described above are merely exemplary. One skilled in the art can readily select appropriate pathways from those disclosed herein to obtain a suitable BDO pathway or other metabolic pathway, as desired.

The invention provides genetically modified organisms that allow improved production of a desired product such as BDO by increasing the product or decreasing undesirable byproducts. As disclosed herein, the invention provides a non-naturally occurring microbial organism, comprising a microbial organism having a 1,4-butanediol (BDO) pathway comprising at least one exogenous nucleic acid encoding a BDO pathway enzyme expressed in a sufficient amount to produce BDO. In one embodiment, the microbial organism is genetically modified to express exogenous succinyl-CoA synthetase (see Example XII). For example, the succinyl-CoA synthetase can be encoded by an *Escherichia coli* sucCD genes.

In another embodiment, the microbial organism is genetically modified to express exogenous alpha-ketoglutarate decarboxylase (see Example XIII). For example, the alpha-ketoglutarate decarboxylase can be encoded by the *Mycobacterium bovis* sucA gene. In still another embodiment, the microbial organism is genetically modified to express exogenous succinate semialdehyde dehydrogenase and 4-hydroxybutyrate dehydrogenase and optionally 4-hydroxybutyryl-CoA/acetyl-CoA transferase (see Example XIII). For example, the succinate semialdehyde dehydrogenase (CoA-dependent), 4-hydroxybutyrate dehydrogenase and 4-hydroxybutyryl-CoA/acetyl-CoA transferase can be encoded by *Porphyromonas gingivalis* W83 genes. In an additional embodiment, the microbial organism is genetically modified to express exogenous butyrate kinase and phosphotransbutyrylase (see Example XIII). For example, the butyrate kinase and phosphotransbutyrylase can be encoded by *Clostridium acetobutilicum* buk1 and ptb genes.

In yet another embodiment, the microbial organism is genetically modified to express exogenous 4-hydroxybutyryl-CoA reductase (see Example XIII). For example, the 4-hydroxybutyryl-CoA reductase can be encoded by *Clostridium beijerinckii* ald gene. Additionally, in an embodiment of the invention, the microbial organism is genetically modified to express exogenous 4-hydroxybutanal reductase (see Example XIII). For example, the 4-hydroxybutanal reductase can be encoded by *Geobacillus thermoglucosidasius* adh1 gene. In another embodiment, the microbial organism is genetically modified to express exogenous pyruvate dehydrogenase subunits (see Example XIV). For example, the exogenous pyruvate dehydrogenase can be NADH insensitive. The pyruvate dehydrogenase subunit can be encoded by the *Klebsiella pneumonia* lpdA gene. In a particular embodiment, the pyruvate dehydrogenase subunit genes of the microbial organism can be under the control of a pyruvate formate lyase promoter.

In still another embodiment, the microbial organism is genetically modified to disrupt a gene encoding an aerobic respiratory control regulatory system (see Example XV). For example, the disruption can be of the arcA gene. Such an organism can further comprise disruption of a gene encoding malate dehydrogenase. In a further embodiment, the microbial organism is genetically modified to express an exogenous NADH insensitive citrate synthase (see Example XV). For example, the NADH insensitive citrate synthase can be encoded by gltA, such as an R163L mutant of gltA. In still another embodiment, the microbial organism is genetically modified to express exogenous phosphoenolpyruvate carboxykinase (see Example XVI). For example, the phosphoenolpyruvate carboxykinase can be encoded by an *Haemophilus influenza* phosphoenolpyruvate carboxykinase gene.

In an additional embodiment, the invention provides a non-naturally occurring microbial organism having a 4-hydroxybutyrate pathway and being capable of producing 4-hydroxybutyrate, wherein the microbial organism comprises a genetic modification that increases expression of phosphoenolpyruvate carboxylase (see Example XXXI). In such an embodiment in which phosphoenolpyruvate expression is increased, the microbial organism can exhibit decreased production of ethanol, acetate, pyruvate or alanine, or a combination thereof, relative to a parent microbial organism in the absence of the genetic modification. As disclosed herein, the overexpression of posphoenolpyruvate (PEP) carboxylase leads to conversion of more phosphoenolpyruvate into oxaloacetate, thereby reducing flux from PEP into pyruvate and subsequently into acetyl-CoA (Example XXXI). Reducing flux from PEP to pyruvate and acetyl-CoA increases flux into the TCA cycle and consequently a 4HB or BDO pathway.

In yet another embodiment, the invention provides a non-naturally occurring microbial organism having a 4-hydroxybutyrate pathway and being capable of producing 4-hydroxybutyrate, wherein the microbial organism comprises a genetic modification that increases expression of alpha-ketoglutarate dehydrogenase (see Example XXXII). The increased expression of alpha-ketoglutarate dehydrogenase can result in decreased production of glutamate relative to a parent microbial organism in the absence of the genetic modification. Such a microbial organism can also exhibit decreased production of ethanol, acetate, pyruvate or alanine, or a combination thereof, relative to a parent microbial organism in the absence of the genetic modification. As disclosed herein, the formation of glutamate can lead to a carbon loss and reduction in yield. Therefore, increased expression of alpha-ketoglutarate dehydrogenase can reduce glutamate as well as other by-products such as ethanol, acetate, alanine and/or pyruvate.

In a further embodiment, the invention provides a non-naturally occurring microbial organism having a 4-hydroxybutyrate pathway and being capable of producing 4-hydroxybutyrate, wherein the microbial organism comprises a genetic modification that increases expression of a non-phosphotransferase (PTS) glucose uptake system (see Example XXXIII). In such an embodiment, the genetic modification can comprise increased expression of a permease, glucokinase, or a glucose facilitator, or a combination thereof. In addition, such a microbial organism can exhibit decreased production of ethanol, acetate, pyruvate, or alanine, or a combination thereof, relative to a parent microbial organism in the absence of the genetic modification. The introduction of a non-PTS sucrose uptake system has been previously described in U.S. publication 2011/0045575 as a way to reduce pyruvate formation in a microbial organism utilizing sucrose as a carbon source. In contrast, the utilization of a non-PTS glucose uptake system, as described herein, is to provide a better balance between the available oxaloacetate in comparison to acetyl-CoA (see Example XXXIII).

In another embodiment, the invention provides a non-naturally occurring microbial organism having a 4-hydroxybutyrate pathway and being capable of producing 4-hydroxybutyrate, wherein the microbial organism comprises a genetic modification that increases expression of a gamma-butyrolactone esterase (Example XXXIV). Such a microbial organism can exhibit decreased production of gamma-butyrolactone relative to a parent microbial organism in the absence of the genetic modification. As disclosed herein, gamma-butyrolactone is a byproduct formed during the fermentation of sugars to 1,4-butanediol. Gamma-butyrolactone can form from the unstable pathway intermediate 4-hydroxybutyryl-CoA as well as spontaneous lactonization of 4-hydroxybutyrate. As disclosed herein, the expression of a gamma-butyrolactone can accelerate the hydrolysis of gamma-butyrolactone to BDO, thereby improving BDO product yield and eliminating a byproduct (see Example XXXIV).

In additional embodiments disclosed herein, a genetic modification can include gene disruptions or deletions to decrease expression of an enzyme. For example, in a further embodiment, the invention provides a non-naturally occurring microbial organism having a 4-hydroxybutyrate pathway and being capable of producing 4-hydroxybutyrate, wherein the microbial organism comprises a genetic modification that decreases expression of succinyl-CoA synthetase (Example XXXV). In such an embodiment, the microbial organism can exhibit increased production of 4-hydroxybutyrate relative to a parent microbial organism in the absence of the genetic modification. As described herein, repeated rounds of flux through the TCA cycle results in carbon loss as $CO_2$. The deletion of succinyl-CoA synthetase blocks the TCA cycle downstream of succinyl-CoA, thereby reducing $CO_2$ loss (see Example XXXV).

In a further embodiment, the invention provides a non-naturally occurring microbial organism having a 4-hydroxybutyrate pathway and being capable of producing 4-hydroxybutyrate, wherein the microbial organism comprises a genetic modification that decreases expression of an acyl coenzyme A thioesterase (see Example XXXVI). In such an embodiment the microbial organism can exhibit decreased production of gamma-butyrolactone relative to a parent microbial organism in the absence of the genetic modification. In yet a further embodiment, such a microbial organism can comprise at least two genetic modifications that decrease expression of at least two acyl coenzyme A thioesterases. As disclosed herein, the BDO pathway intermediate 4-hydroxybutyryl-CoA spontaneously and enzymatically cyclizes to form gamma-butyrolactone (GBL). By deleting acyl coenzyme-A thioesterases, the formation of the byproduct GBL was reduced (see Example XXXVI).

In another embodiment, the invention provides a non-naturally occurring microbial organism having a 4-hydroxybutyrate pathway and being capable of producing 4-hydroxybutyrate, wherein the microbial organism comprises a genetic modification that decreases expression of an alcohol dehydrogenase (see Example XXXVII). In such an embodiment, the microbial organism can exhibit decreased backflux from a downstream product of the 4-hydroxybutyrate pathway relative to a parent microbial organism in the absence of said genetic modification. At high titers of BDO, a downstream product from 4-hydroxybutyrate, the high concentrations of product can result in backflux within the pathway or through side reactions, thereby resulting in a decreased product yield and/or an increase in toxic byproduct formation such as aldehydes. As described herein, several endogenous alcohol dehydrogenases were found to contribute to backflux, whereas deletion of one or more of the endogenous alcohol dehydrogenases decreased backflux without reducing production of 4-hydroxybutyrate or BDO, and in fact increased BDO formation (see Example XXXVII).

In still another embodiment, the invention provides a non-naturally occurring microbial organism having a 4-hydroxybutyrate pathway and being capable of producing 4-hydroxybutyrate, wherein the microbial organism comprises a genetic modification that decreases expression of a non-energy-producing NADH dehydrogenase (see Example XXXVIII). The decreased expression of a non-energy-producing NADH dehydrogenase suppresses depletion of the NADH pool resulting from the activity of the non-energy-producing NADH dehydrogenase. Additionally, the microbial organisms exhibit increased energy efficiency in the microbial organism relative to a parent microbial organism in the absence of the genetic modification. As described herein, the electron transport chain has multiple NADH dehydrogenases and cytochrome oxidases with varying ability to translocate protons. Some NADH dehydrogenases consume NADH without linking the consumption to proton translocation and energy production, and such NADH dehydrogenases are considered to be non-energy-producing NADH dehydrogenases. One exemplary non-energy-producing NADH dehydrogenase is NADH II of *E. coli* (see Example XXXVIII). Additional genes encoding enzymes with non-energy producing NAD(P)H dehydrogenase activities include wrbA, yieF, and kefF. One skilled in the art will readily understand the meaning of a non-energy-producing NADH dehydrogenase as one that does not couple NADH oxidation to electron transport and proton translocation and the formation of ATP. By decreasing expression of a non-energy-producing NADH dehydrogenase, the depletion of the NADH pool within the cell is suppressed, thereby making the cell more energy efficient and/or allowing NADH to be utilized in desired synthetic pathways.

In a further embodiment, the invention provides a non-naturally occurring microbial organism having a 4-hydroxybutyrate pathway and being capable of producing 4-hydroxybutyrate, wherein the microbial organism comprises a genetic modification that decreases expression of a cytochrome oxidase (see Example XXXIX). In such an embodiment, the microbial organism can exhibit increased energy efficiency relative to a parent microbial organism in the absence of the genetic modification. As disclosed herein, cytochrome oxidases involved in the electron transport chain have different energy-conserving efficiencies. By decreasing expression of one or more cytochrome oxidases, the energy efficiency of the cell can be increased (see Example XXXIX). Even in a case where an increase in product yield is not observed under certain conditions (see Example XXXIX), such genetic modifications can be advantageous in providing a greater tolerance for a range of oxygen concentrations, in particular producing a product more efficiently in a large fermentor, where the available oxygen varies within the ferementor. By improving the energy efficiency of the microbial organism, the organism can tolerate lower oxygen conditions since need for energy production from the electron transport chain is reduced. Thus, in a particular embodiment of the invention, the microbial organism can exhibit an increased tolerance to a range of oxygen concentrations relative to a parent microbial organism in the absence of said genetic modification.

The invention thus provides a non-naturally occurring microbial organism having a 4-hydroxybutyrate pathway and being capable of producing 4-hydroxybutyrate, wherein the microbial organism comprises a genetic modification, the genetic modification selected from: (A) a genetic modification that increases expression of acetate kinase and phosphotransacetylase; (B) a genetic modification that inactivates expression of an aerobic respiratory control regulatory system; (C) a genetic modification that truncates a glucose phosphotransferase system (PTS) permease; (D) a genetic modification that increases expression of phosphoenolpyruvate carboxylase; (E) a genetic modification that increases expression of alpha-ketoglutarate dehydrogenase; (F) a genetic modification that increases expression of a non-phosphotransferase (PTS) glucose uptake system; (G) a genetic modification that increases expression of a gamma-butyrolactone esterase; (H) a genetic modification that decreases expression of succinyl-CoA synthetase; (I) a genetic modification that decreases expression of an acyl coenzyme A thioesterase; (J) a genetic modification that decreases expression of an alcohol dehydrogenase; (K) a genetic modification that decreases expression of a non-energy-producing NADH dehydrogenase; (L) a genetic modification that decreases expression of a cytochrome oxidase; and (M) a combination of two or more, for example, three or more, four or more, five or more, six or more, seven or more, eight or more, or nine or more, ten or more, eleveno or more, or all of the genetic modifications of parts (A)-(L).

In another embodiment, the invention provides a microbial organism comprising a genetic modification, where the genetic modification is selected from: (A) a genetic modification that increases expression of acetate kinase and phosphotransacetylase; (B) a genetic modification that inactivates expression of an aerobic respiratory control regulatory system; (C) a genetic modification that truncates a glucose phosphotransferase system (PTS) permease; and (N) a combination of two or more, or all of the genetic modifications of parts (A)-(C). In a further embodiment, such a microbial organism can further comprise a genetic modification is selected from: (D) a genetic modification that increases expression of phosphoenolpyruvate carboxylase; (E) a genetic modification that increases expression of alpha-ketoglutarate dehydrogenase; (F) a genetic modification that increases expression of a non-phosphotransferase (PTS) glucose uptake system; (G) a genetic modification that increases expression of a gamma-butyrolactone esterase; (H) a genetic modification that decreases expression of succinyl-CoA synthetase; (I) a genetic modification that decreases expression of an acyl coenzyme A thioesterase; (J) a genetic modification that decreases expression of an alcohol dehydrogenase; (K) a genetic modification that decreases expression of a non-energy-producing NADH dehydrogenase; (L) a genetic modification that decreases expression of a cytochrome oxidase; and (M) a combination of two or more, three or more, four or more, five or more, six or more, seven or more, eight or more, nine or more, ten or more, eleven or more, or all of the genetic modifications of parts (A)-(L).

In further particular embodiments, (a) the microbial organism of part (A) has increased conversion of acetate to acetyl-CoA and/or reduced secretion of acetate; (b) the microbial organism of part (B) has an inactivation mutation in arcA by an insertion in the coding sequence; (c) the microbial organism of part (C) has reduced glucose uptake and/or decreased production of acetate, pyruvate and/or glutamate; (d) the microbial organism of part (D), (E), or (F) has decreased production of ethanol, acetate, pyruvate or alanine, or a combination thereof, relative to a parent microbial organism in the absence of said genetic modification; (e) the microbial organism of part (E) has decreased production of glutamate relative to a parent microbial organism in the absence of said genetic modification; (f) the microbial organism of part (F) has a genetic modification comprising increased expression of a permease, glucokinase, or a glucose facilitator, or a combination thereof; (g) the microbial organism of part (G) has decreased production of gamma-butyrolactone relative to a parent microbial organism in the absence of said genetic modification; (h) the microbial organism of part (H) has increased production of 4-hydroxybutyrate relative to a parent microbial organism in the absence of said genetic modification; (i) the microbial organism of part (I) has decreased production of gamma-butyrolactone relative to a parent microbial organism in the absence of said genetic modification; (j) the microbial organism of part (I) has a genetic modification comprising at least two genetic modifications that decrease expression of at least two acyl coenzyme A thioesterases; (k) the microbial organism of part (J) has decreased backflux from a downstream product of the 4-hydroxybutyrate pathway relative to a parent microbial organism in the absence of said genetic modification; (1) the microbial organism of part (K) has suppressed depletion of the NADH pool or increased energy efficiency in the microbial organism, or a combination thereof, relative to a parent microbial organism in the absence of said genetic modification; (m) the microbial organism of part (L) has increased energy efficiency relative to a parent microbial organism in the absence of said genetic modification; or (n) the microbial organism of part (L) has increased tolerance to a range of oxygen concentrations relative to a parent microbial organism in the absence of said genetic modification.

In a further embodiment, the invention provides a microbial organism, where the microbial organism of parts (G) or (I) further comprises a 4-hydroxybutyryl-CoA pathway. Additional metabolic modifications include, but are not limited to, a genetic modification that increases expression of acetate kinase and/or phosphotransacetylase (see Example XXXX), a genetic modification that decreases expression of arcA, in particular an insertion mutation (see Example XXXXI), or a genetic modification in which a glucose permease is a modified variant such as a truncation (see Example XXXXII). The invention further provides a method for producing 4-hydroxybutyrate utilizing such microbial organisms. It is understood that such genetic modifications include, but are not limited to, the specifically described gene additions and disruptions described in Examples XXIV-XXXXII. It is understood that the genetic modifications described herein can be used alone or in combination with other genetic modifications, particularly those disclosed herein, as desired to provide desirable characteristics of a production strain. In the case of gene disruptions, it is understood that such disruptions involve disruption of an endogenous gene encoding an activity of a corresponding gene product to be decreased.

In still a further embodiment, a microbial organism of the invention can further comprise a metabolic modification selected from: (i) a genetic modification that increases expression of pyruvate dehydrogenase; (ii) a genetic modification that decreases expression of an aerobic respiratory control regulatory system; (iii) a genetic modification that increases expression of an NADH insensitive citrate synthase; (iv) a genetic modification that decreases expression of malate dehydrogenase; (v) a genetic modification that decreases expression of lactate dehydrogenase; (vi) a genetic modification that decreases expression of alcohol dehydrogenase; (vii) a genetic modification that decreases expression of pyruvate formate lyase; (viii) a genetic modification that increases expression of phosphoenolpyruvate carboxykinase; and (ix) a combination of two or more, three or more, four or more, five or more, six or more, seven or more, or all of the genetic modifications of parts (i)-(viii).

Although the pathways immediately above are directed to 4-HB pathways, it is understood, as disclosed herein, the 4-HB is a precursor to downstream products such as 1,4-butanediol (BDO). Further, as disclosed herein, a microbial organism having a 4-HB pathway can further include enzymes that convert 4-HB to a downstream product such as BDO, as desired. In addition, any of the pathways described herein that produce 4-HB are understood to provide a 4-HB pathway, even if additional steps in a pathway are also disclosed since such a pathway produces 4-HB. Thus, the invention provides microbial organisms comprising a 4-HB pathway or a BDO pathway, wherein the organism comprises one or more of the genetic modifications disclosed herein and produces 4-HB, 4-HB-CoA, or BDO, as well as methods of producing products such as 4-HB, 4-HB-CoA and/or BDO using such an organism. It is further understood that the genetic modifications can be used alone or in various combinations of one or more of the genetic modifications, as disclosed herein (see Examples). Additionally, it is understood that a genetic modification can result in a desired effect, including but not limited to increased product yield, decreased byproduct production, in particular toxic or growth suppressive byproducts, for example, aldehydes, improved strain culture growth or fermentation characteristics, improved ability to isolate or purify a desired product, and the like. Furthermore, it is understood that increased production of a downstream product, for example, BDO, can be indicative of increased production of an upstream product, for example, a pathway intermediate such as 4HB, where increased production of the downstream product indicates increased flux through an upstream product. One skilled in the art can readily understand these or other desirable characteristics of a microbial organism of the invention for producing a desired pathway product or intermediate. Thus, using methods disclosed herein and those well known in the art, one skilled in the art can incorporate various metabolic modifications, incorporate appropriate expression control elements and/or methods, and/or variant enzymes to provide a microbial organism having optimized production properties. It is further understood that such optimized production properties can be readily determined by those skilled in the art, including increasing or decreasing the expression level of a particular molecule, including metabolic modifications and/or enzymes or proteins of a 4-HB, 4-HBal, 4-HBCoA, BDO or putrescine pathway.

As used herein, the term "parent microbial organism," when used in the context of a genetic modification, is understood to mean a parent organism or strain in which the particular genetic modification has not been made but otherwise has the same genetic makeup. For example, if a strain of microbial organism is used to make a genetic modification that increases expression of a gene product, the parent strain would be the starting strain into which the heterologous gene is introduced. Similarly, a parent microbial organism of an organism in which a genetic modification has been made to decrease expression, such as a gene disruption or gene deletion, the parent microbial organism would have the same genetic background except for the gene disruption or deletion. However, it is understood that a parent microbial organism can differ by more than one genetic modification, either gene addition and/or disruption, depending on whether a single or multiple genetic modifications are being considered. One skilled in the art will readily understand the meaning of such a parent microbial organism in that the microbial organism is considered to be an appropriate control, as understood in the art, for observing the effect of one or more genetic modifications.

In addition, it is understood by those skilled in the art that a genetic modification such as those disclosed herein can contribute to an increase in product yield, a decrease in by-product formation, and/or improved characteristics of the microbial organism. Such improved characteristics include, but are not limited to, improved cell growth, increased energy efficiency, increased tolerance of a range of oxygen concentrations, particularly when manifested in a scaled up production process such as in large fermentors. A useful genetic modification may not alone, when compared to a parent microbial organism, exhibit an effect that can readily measured under a given set of conditions. However, a useful genetic modification can be advantageous if the modification on its on under a given set of conditions and/or in combination with one or more other genetic modifications is beneficial to the growth and/or production characteristics of the microbial organism.

It is understood that a genetic modification that increases expression of a desired enzyme is generally carried out by introducing into the microbial organism a heterologous nucleic acid encoding the desired enzyme. However, it is understood, as described herein, that a metabolic modification to increase expression can include modification of a regulatory region of an endogenous gene, such as a promoter and/or enhancer. Additionally, a genetic modification that decreases expression of a desired enzyme will generally involve a gene disruption or deletion, although modification of a regulatory to decrease expression can also be utilized, as disclosed herein.

It is further understood that any of a number of genetic modifications, as disclosed herein, can be used alone or in various combinations of one or more of the genetic modifications disclosed herein to increase the production of BDO in a BDO producing microbial organism. In a particular embodiment, the microbial organism can be genetically modified to incorporate any and up to all of the genetic modifications that lead to increased production of BDO. In a particular embodiment, the microbial organism containing a BDO pathway can be genetically modified to express exogenous succinyl-CoA synthetase; to express exogenous alpha-ketoglutarate decarboxylase; to express exogenous succinate semialdehyde dehydrogenase and 4-hydroxybutyrate dehydrogenase and optionally 4-hydroxybutyryl-CoA/acetyl-CoA transferase; to express exogenous butyrate kinase and phosphotransbutyrylase; to express exogenous 4-hydroxybutyryl-CoA reductase; and to express exogenous 4-hydroxybutanal reductase; to express exogenous pyruvate dehydrogenase; to disrupt a gene encoding an aerobic respiratory control regulatory system; to express an exogenous NADH insensitive citrate synthase; and to express exogenous phosphoenolpyruvate carboxykinase. Such strains for improved production are described in Examples XII-XIX. It is thus understood that, in addition to the modifications described above, such strains can additionally include other modifications disclosed herein. Such modifications include, but are not limited to, deletion of endogenous lactate dehydrogenase (ldhA), alcohol dehydrogenase (adhE), and/or pyruvate formate lyase (pflB)(see Examples XII-XIX and Table 18). Additional genetic modifications that can be introduced into a microbial organism include those described in Examples XXIV-XXXX alone or in combination, including in combination with other genetic modifications disclosed herein.

The invention additionally provides a microbial organism that, in addition to one or more of the metabolic modifications of (A)-(J) described above, optionally further comprises a metabolic modification selected from (i) a genetic modification that increases expression of pyruvate dehydrogenase; (ii) a genetic modification that decreases expression of an aerobic respiratory control regulatory system; (iii) a genetic modification that increases expression of an NADH insensitive citrate synthase; (iv) a genetic modification that decreases expression of malate dehydrogenase; (v) a genetic modification that decreases expression of lactate dehydrogenase; (vi) a genetic modification that decreases expression of alcohol dehydrogenase; (vii) a genetic modification that decreases expression of pyruvate formate lyase; and (viii) a combination of two or more, three or more, four or more, five or more, six or more, or all of the genetic modifications of parts (i)-(vii). It is understood that any of the various combinations of metabolic modifications disclosed herein can be combined with each other, or with individual metabolic modifications A-P, to generate further combinations.

Additionally provided is a microbial organism in which one or more genes encoding the exogenously expressed enzymes are integrated into the fimD locus of the host organism (see Example XVII). For example, one or more genes encoding a BDO, 4-HB, 4-HBal, 4-HBCoA and/or putrescine pathway enzyme can be integrated into the fimD locus for increased production of BDO, 4-HB, 4-HBal, 4-HBCoA and/or putrescine. Further provided is a microbial organism expressing a non-phosphotransferase sucrose uptake system that increases production of BDO.

Although the genetically modified microbial organisms disclosed herein are exemplified with microbial organisms containing particular BDO, 4-HB, 4-HBal, 4-HBCoA and/or putrescine pathway enzymes, it is understood that such modifications can be incorporated into any microbial organism having a BDO, 4-HB, 4-HBal, 4-HBCoA and/or putrescine pathway suitable for enhanced production in the presence of the genetic modifications of any of the pathways disclosed herein. The microbial organisms of the invention can thus have any of the BDO, 4-HB, 4-HBal, 4-HBCoA and/or putrescine pathways disclosed herein (see, for example, FIGS. 1, 8-13, 58, 62, 63, 69 and 70). For example, if a depicted pathway shows a BDO pathway, whereas 4-hydroxybutyrate is an intermediate of the BDO pathway, it is understood, as disclosed herein, that a pathway to 4-hydroxybutyrate is also provided, if desired. Thus, the pathways described herein can produce an end product of a depicted pathway or a desired intermediate of a depicted pathway, as described herein. It is further understood that a pathway enzyme can be a variant enzyme, including but not limited to the variant enzymes disclosed herein (see Example XXXXIII) so long as the pathway produces a desired pathway end product or pathway intermediate.

In an embodiment of the invention, a microbial organism is provided comprising a metabolic modification and a pathway to a desired product such as BDO, 4-HB, 4-HBal, 4-HBCoA and/or putrescine. Exemplary pathways are disclosed herein and include the pathways depicted in FIGS. 1, 8-13, 58, 62, 63, 69 and 70. In one embodiment, the microbial organism comprises a 4-hydroxybutanoic acid (4-HB) and/or 1,4-butanediol (1,4-BDO) biosynthetic pathway comprising an α-ketoglutarate decarboxylase, or an α-ketoglutarate dehydrogenase and a CoA-dependent succinic semialdehyde dehydrogenase, or a glutamate: succinate semialdehyde transaminase and a glutamate decarboxylase; a 4-hydroxybutanoate dehydrogenase; a 4-hydroxybutyryl-CoA:acetyl-CoA transferase, or a butyrate kinase and a phosphotransbutyrylase; an aldehyde dehydrogenase; and an alcohol dehydrogenase.

In another embodiment, the microbial organism can comprise a 4-HB and/or BDO pathway comprising alpha-ketoglutarate decarboxylase, or alpha-ketoglutarate dehydrogenase and CoA-dependent succinate semialdehyde dehydrogenase, or glutamate: succinate semialdehyde transaminase and glutamate decarboxylase; 4-hydroxybutyrate dehydrogenase; 4-hydroxybutyryl-CoA transferase, or 4-hydroxybutyrate kinase and phosphotrans-4-hydroxybutyrylase; 4-hydroxybutyryl-CoA reductase; and 4-hydroxybutyraldehyde reductase, or aldehyde/alcohol dehydrogenase. In still another embodiment, the microbial organisms can comprise a 4-HB and/or BDO pathway comprising alpha-ketoglutarate decarboxylase, or succinyl-CoA synthetase and CoA-dependent succinate semialdehyde dehydrogenase; 4-hydroxybutyrate dehydrogenase; 4-hydroxybutyryl-CoA transferase, or 4-hydroxybutyrate kinase and phosphotrans-4-hydroxybutyrylase; and aldehyde dehydrogenase; and alcohol dehydrogenase, or aldehyde/alcohol dehydrogenase. In another embodiment, the microbial organism can comprise a 4-HB and/or BDO pathway comprising alpha-ketoglutarate decarboxylase, or glutamate dehydrogenase and glutamate decarboxylase, and deaminating 4-aminobutyrate oxidoreductase or 4-aminobutyrate transaminase, or alpha-ketoglutarate dehydrogenase and CoA-dependent succinate semialdehyde dehydrogenase; 4-hydroxybutyrate dehydrogenase; and 4-hydroxybutyrate kinase and phosphotrans-4-hydroxybutyrylase and 4-hydroxybutyryl-CoA reductase and 4-hydroxybutyraldehyde reductase, or 4-hydroxybutyrate kinase and phosphorylating 4-hydroxybutanal dehydrogenase and 4-hydroxybutyraldehyde reductase, or 4-hydroxybutyrate kinase and phosphotrans-4-hydroxybutyrylase and alcohol forming 4-hydroxybutyryl-CoA reductase, or 4-hydroxybutyryl-CoA transferase or 4-hydroxybutyryl-CoA hydrolase or 4-hydroxybutyryl-CoA ligase and 4-hydroxybutyryl-CoA reductase and 4-hydroxybutyraldehyde reductase, or 4-hydroxybutyryl-CoA transferase or 4-hydroxybutyryl-CoA hydrolase or 4-hydroxybutyryl-CoA ligase and alcohol forming 4-hydroxybutyryl-CoA reductase. In yet another embodiment, the microbial organism can comprise a BDO pathway comprising glutamate CoA transferase or glutamyl-CoA hydrolase or glutamyl-CoA ligase and glutamyl-CoA reductase and glutamate-5-semialdehyde reductase, or glutamate CoA transferase or glutamyl-CoA hydrolase or glutamyl-CoA ligase and alcohol forming glutamyl-CoA reductase, or glutamate 5-kinase and phosphorylating glutamate-5-semialdehyde dehydrogenase and glutamate-5-semialdehyde reductase; deaminating 2-amino-5-hydroxypentanoic acid oxidoreductase or 2-amino-5-hydroxypentanoic acid transaminase; and 5-hydroxy-2-oxopentanoic acid decarboxylase and 4-hydroxybutyraldehyde reductase, or decarboxylating 5-hydroxy-2-oxopentanoic acid dehydrogenase and 4-hydroxybutyryl-CoA reductase and 4-hydroxybutyraldehyde reductase; or decarboxylating 5-hydroxy-2-oxopentanoic acid dehydrogenase and alcohol forming 4-hydroxybutyryl-CoA reductase.

In a further embodiment of the invention, the microbial organism can comprise a 4-HB and/or BDO pathway comprising 3-hydroxybutyryl-CoA dehydrogenase; 3-hydroxybutyryl-CoA dehydratase; vinylacetyl-CoA Δ-isomerase; 4-hydroxybutyryl-CoA dehydratase; and 4-hydroxybutyryl-CoA reductase (alcohol forming); or 4-hydroxybutyryl-CoA reductase and 1,4-butanediol dehydrogenase.

In still a further embodiment of the invention, the microbial organism can comprise a 4-HB and/or BDO pathway comprising glutamate CoA transferase; glutamyl-CoA hydrolase; glutamyl-CoA ligase; glutamate 5-kinase; glutamate-5-semialdehyde dehydrogenase (phosphorylating); glutamyl-CoA reductase; glutamate-5-semialdehyde reductase; glutamyl-CoA reductase (alcohol forming); 2-amino-5-hydroxypentanoic acid oxidoreductase (deaminating); 2-amino-5-hydroxypentanoic acid transaminase; 5-hydroxy-2-oxopentanoic acid decarboxylase; and 5-hydroxy-2-oxopentanoic acid dehydrogenase (decarboxylation); and optionally 4-hydroxybutyryl-CoA reductase (alcohol forming), 4-hydroxybutyryl-CoA reductase, or 1,4-butanediol dehydrogenase. In another embodiment, the microbial organism can comprise a 4-HB and/or BDO pathway comprising glutamate CoA transferase; glutamyl-CoA hydrolase; glutamyl-CoA ligase; glutamate 5-kinase; glutamate-5-semialdehyde dehydrogenase (phosphorylating); glutamyl-CoA reductase; glutamate-5-semialdehyde reductase; glutamyl-CoA reductase (alcohol forming); 2-amino-5-hydroxypentanoic acid oxidoreductase (deaminating); 2-amino-5-hydroxypentanoic acid transaminase; 5-hydroxy-2-oxopentanoic acid decarboxylase; and 5-hydroxy-2-oxopentanoic acid dehydrogenase (decarboxylation); and optionally 4-hydroxybutyryl-CoA reductase (alcohol forming), 4-hydroxybutyryl-CoA reductase, or 1,4-butanediol dehydrogenase.

In another embodiment of the invention, the microbial organism can comprise a 4-HB and/or BDO pathway comprising glutamate dehydrogenase; glutamate decarboxylase; 4-aminobutyrate oxidoreductase (deaminating); and 4-hydroxybutyrate dehydrogenase; and further comprising (a) 4-hydroxybutyrate kinase; phosphotrans-4-hydroxybutyrylase; 4-hydroxybutyryl-CoA reductase; and 1,4-butanediol dehydrogenase; (b) 4-hydroxybutyryl-CoA transferase, 4-hydroxybutyryl-CoA hydrolase, or 4-hydroxybutyryl-CoA ligase; 4-hydroxybutyryl-CoA reductase; and 1,4-butanediol dehydrogenase; (c) 4-hydroxybutyryl-CoA transferase, 4-hydroxybutyryl-CoA hydrolase, or 4-hydroxybutyryl-CoA ligase; and 4-hydroxybutyryl-CoA reductase (alcohol forming); (d) 4-hydroxybutyrate kinase; 4-hydroxybutanal dehydrogenase (phosphorylating); and 1,4-butanediol; or (e) 4-hydroxybutyrate kinase; phosphotrans-4-hydroxybutyrylase; and 4-hydroxybutyryl-CoA reductase (alcohol forming). In still another embodiment, the microbial organism can comprise a 4-HB and/or BDO pathway comprising alpha-ketoglutarate decarboxylase, or glutamate dehydrogenase and glutamate decarboxylase and 4-aminobutyrate transaminase; and 4-hydroxybutyrate dehydrogenase; and further comprising (a) 4-hydroxybutyryl-CoA ligase; 4-hydroxybutyryl-CoA reductase; and 1,4-butanediol dehydrogenase; (b) 4-hydroxybutyryl-CoA transferase, 4-hydroxybutyryl-CoA hydrolase, or 4-hydroxybutyryl-CoA ligase; and 4-hydroxybutyryl-CoA reductase (alcohol forming); (c) 4-hydroxybutyrate kinase; 4-hydroxybutanal dehydrogenase (phosphorylating); and 1,4-butanediol dehydrogenase; or (d) 4-hydroxybutyrate kinase; phosphotrans-4-hydroxybutyrylase; and 4-hydroxybutyryl-CoA reductase (alcohol forming). In yet another embodiment, the microbial organism can comprise a 4-HB and/or BDO pathway comprising alpha-ketoglutarate dehydrogenase; CoA-dependent succinic semialdehyde dehydrogenase; and 4-hydroxybutyrate dehydrogenase; and further comprising (a) 4-hydroxybutyryl-CoA ligase; 4-hydroxybutyryl-CoA reductase; and 1,4-butanediol dehydrogenase; (b) 4-hydroxybutyryl-CoA transferase, 4-hydroxybutyryl-CoA hydrolase, or 4-hydroxybutyryl-CoA ligase; and 4-hydroxybutyryl-CoA reductase (alcohol forming); (c) 4-hydroxybutyrate kinase; 4-hydroxybutanal dehydrogenase (phosphorylating); and 1,4-butanediol dehydrogenase; or (d) 4-hydroxybutyrate kinase; phosphotrans-4-hydroxybutyrylase; and 4-hydroxybutyryl-CoA reductase (alcohol forming).

In a further embodiment, the microbial organism can comprise a 4-HB and/or 4-hydroxybutanal and/or BDO pathway comprising succinyl-CoA reductase (aldehyde forming); 4-hydroxybutyrate dehydrogenase; and 4-hydroxybutyrate reductase, also referred to herein as carboxylic acid reductase. In another embodiment, the microbial organism can comprise a 4-HB and/or 4-hydroxybutanal and/or BDO pathway comprising alpha-ketoglutarate decarboxylase; 4-hydroxybutyrate dehydrogenase; and 4-hydroxybutyrate reductase, also referred to herein as carboxylic acid reductase.

For example, the BDO pathway can comprise 4-hydroxybutanoate dehydrogenase, succinyl-CoA synthetase, CoA-dependent succinic semialdehyde dehydrogenase, 4-hydroxybutyrate:CoA transferase, 4-butyrate kinase, phosphotransbutyrylase, alpha-ketoglutarate decarboxylase, aldehyde dehydrogenase, alcohol dehydrogenase or an aldehyde/alcohol dehydrogenase (see FIG. 1). Alternatively, the BDO pathway can comprise 4-aminobutyrate CoA transferase, 4-aminobutyryl-CoA hydrolase, 4-aminobutyrate-CoA ligase, 4-aminobutyryl-CoA oxidoreductase (deaminating), 4-aminobutyryl-CoA transaminase, or 4-hydroxybutyryl-CoA dehydrogenase (see Table 17 in WO2013/184602). Such a BDO pathway can further comprise 4-hydroxybutyryl-CoA reductase (alcohol forming), 4-hydroxybutyryl-CoA reductase, or 1,4-butanediol dehydrogenase.

Additionally, the BDO pathway can comprise 4-aminobutyrate CoA transferase, 4-aminobutyryl-CoA hydrolase, 4-aminobutyrate-CoA ligase, 4-aminobutyryl-CoA reductase (alcohol forming), 4-aminobutyryl-CoA reductase, 4-aminobutan-1-ol dehydrogenase, 4-aminobutan-1-ol oxidoreductase (deaminating) or 4-aminobutan-1-ol transaminase (see Table 18 in WO2013/184602). Also, the BDO pathway can comprise 4-aminobutyrate kinase, 4-aminobutyraldehyde dehydrogenase (phosphorylating), 4-aminobutan-1-ol dehydrogenase, 4-aminobutan-1-ol oxidoreductase (deaminating), 4-aminobutan-1-ol transaminase, [(4-aminobutanolyl)oxy]phosphonic acid oxidoreductase (deaminating), [(4-aminobutanolyl)oxy]phosphonic acid transaminase, 4-hydroxybutyryl-phosphate dehydrogenase, or 4-hydroxybutyraldehyde dehydrogenase (phosphorylating) (see Table 19 in WO2013/184602). Such a pathway can further comprise 1,4-butanediol dehydrogenase.

The BDO pathway can also comprise alpha-ketoglutarate 5-kinase, 2,5-dioxopentanoic semialdehyde dehydrogenase (phosphorylating), 2,5-dioxopentanoic acid reductase, alpha-ketoglutarate CoA transferase, alpha-ketoglutaryl-CoA hydrolase, alpha-ketoglutaryl-CoA ligase, alpha-ketoglutaryl-CoA reductase, 5-hydroxy-2-oxopentanoic acid dehydrogenase, alpha-ketoglutaryl-CoA reductase (alcohol forming), 5-hydroxy-2-oxopentanoic acid decarboxylase, or 5-hydroxy-2-oxopentanoic acid dehydrogenase (decarboxylation)(see Table 20 in WO2013/184602). Such a BDO pathway can further comprise 4-hydroxybutyryl-CoA reductase (alcohol forming), 4-hydroxybutyryl-CoA reductase, or 1,4-butanediol dehydrogenase. Additionally, the BDO pathway can comprise glutamate CoA transferase, glutamyl-CoA hydrolase, glutamyl-CoA ligase, glutamate 5-kinase, glutamate-5-semialdehyde dehydrogenase (phosphorylating), glutamyl-CoA reductase, glutamate-5-semialdehyde reductase, glutamyl-CoA reductase (alcohol forming), 2-amino-5-hydroxypentanoic acid oxidoreductase (deaminating), 2-amino-5-hydroxypentanoic acid transaminase, 5-hydroxy-2-oxopentanoic acid decarboxylase, 5-hydroxy-2-oxopentanoic acid dehydrogenase (decarboxylation)(see Table 21 in WO2013/184602). Such a BDO pathway can further comprise 4-hydroxybutyryl-CoA reductase (alcohol forming), 4-hydroxybutyryl-CoA reductase, or 1,4-butanediol dehydrogenase.

Additionally, the BDO pathway can comprise 3-hydroxybutyryl-CoA dehydrogenase, 3-hydroxybutyryl-CoA dehydratase, vinylacetyl-CoA Δ-isomerase, or 4-hydroxybutyryl-CoA dehydratase (see Table 22 in WO2013/184602). Also, the BDO pathway can comprise homoserine deaminase, homoserine CoA transferase, homoserine-CoA hydrolase, homoserine-CoA ligase, homoserine-CoA deaminase, 4-hydroxybut-2-enoyl-CoA transferase, 4-hydroxybut-2-enoyl-CoA hydrolase, 4-hydroxybut-2-enoyl-CoA ligase, 4-hydroxybut-2-enoate reductase, 4-hydroxybutyryl-CoA transferase, 4-hydroxybutyryl-CoA hydrolase, 4-hydroxybutyryl-CoA ligase, or 4-hydroxybut-2-enoyl-CoA reductase (see Table 23 in WO2013/184602). Such a BDO pathway can further comprise 4-hydroxybutyryl-CoA reductase (alcohol forming), 4-hydroxybutyryl-CoA reductase, or 1,4-butanediol dehydrogenase.

The BDO pathway can additionally comprise succinyl-CoA reductase (alcohol forming), 4-hydroxybutyryl-CoA hydrolase, 4-hydroxybutyryl-CoA ligase, or 4-hydroxybutanal dehydrogenase (phosphorylating) (see Table 15 in WO2013/184602). Such a pathway can further comprise succinyl-CoA reductase, 4-hydroxybutyrate dehydrogenase, 4-hydroxybutyryl-CoA transferase, 4-hydroxybutyrate kinase, phosphotrans-4-hydroxybutyrylase, 4-hydroxybutyryl-CoA reductase, 4-hydroxybutyryl-CoA reductase (alcohol forming), or 1,4-butanediol dehydrogenase. Also, the BDO pathway can comprise glutamate dehydrogenase, 4-aminobutyrate oxidoreductase (deaminating), 4-aminobutyrate transaminase, glutamate decarboxylase, 4-hydroxybutyryl-CoA hydrolase, 4-hydroxybutyryl-CoA ligase, or 4-hydroxybutanal dehydrogenase (phosphorylating)(see Table 16 in WO2013/184602). Such a BDO pathway can further comprise alpha-ketoglutarate decarboxylase, 4-hydroxybutyrate dehydrogenase, 4-hydroxybutyryl-CoA transferase, 4-hydroxybutyrate kinase, phosphotrans-4-hydroxybutyrylase, 4-hydroxybutyryl-CoA reductase, 4-hydroxybutyryl-CoA reductase (alcohol forming), or 1,4-butanediol dehydrogenase.

Figure 58:
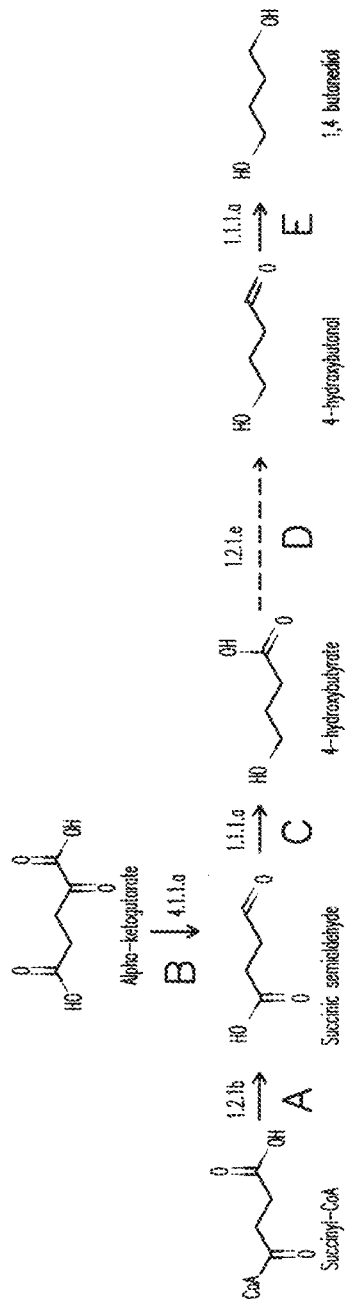
FIG. 58 shows exemplary pathways to 1,4-butanediol from succcinyl-CoA and alpha-ketoglutarate. Abbreviations: A) Succinyl-CoA reductase (aldehyde forming), B) Alpha-ketoglutarate decarboxylase, C) 4-Hydroxybutyrate dehydrogenase, D) 4-Hydroxybutyrate reductase, E) 1,4-Butanediol dehydrogenase.

The invention additionally provides a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising succinyl-CoA reductase (aldehyde forming); 4-hydroxybutyrate dehydrogenase; and 4-hydroxybutyrate reductase (see FIG. 58, steps A-C-D). The invention also provides a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising alpha-ketoglutarate decarboxylase; 4-hydroxybutyrate dehydrogenase; and 4-hydroxybutyrate reductase (FIG. 58, steps B-C-D).

The invention further provides a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising succinate reductase; 4-hydroxybutyrate dehydrogenase, and 4-hydroxybutyrate reductase (see FIG. 62, steps F-C-D). In yet another embodiment, the invention provides a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising alpha-ketoglutarate decarboxylase, or glutamate dehydrogenase or glutamate transaminase and glutamate decarboxylase and 4-aminobutyrate dehydrogenase or 4-aminobutyrate transaminase; 4-hydroxybutyrate dehydrogenase; and 4-hydroxybutyrate reductase (see FIG. 62, steps B or ((J or K)-L-(M or N))-C-D).

The invention also provides a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising alpha-ketoglutarate reductase; 5-hydroxy-2-oxopentanoate dehydrogenase; and 5-hydroxy-2-oxopentanoate decarboxylase (see FIG. 62, steps X-Y-Z). In yet another embodiment, the invention provides a non-naturally occurring microbial organism, comprising a 4-hydroxybutyryl-CoA pathway comprising at least one exogenous nucleic acid encoding a 4-hydroxybutyryl-CoA pathway enzyme expressed in a sufficient amount to produce 4-hydroxybutyryl-CoA, the 4-hydroxybutyryl-CoA pathway comprising alpha-ketoglutarate reductase; 5-hydroxy-2-oxopentanoate dehydrogenase; and 5-hydroxy-2-oxopentanoate dehydrogenase (decarboxylation) (see FIG. 62, steps X-Y-AA).

Figure 63:
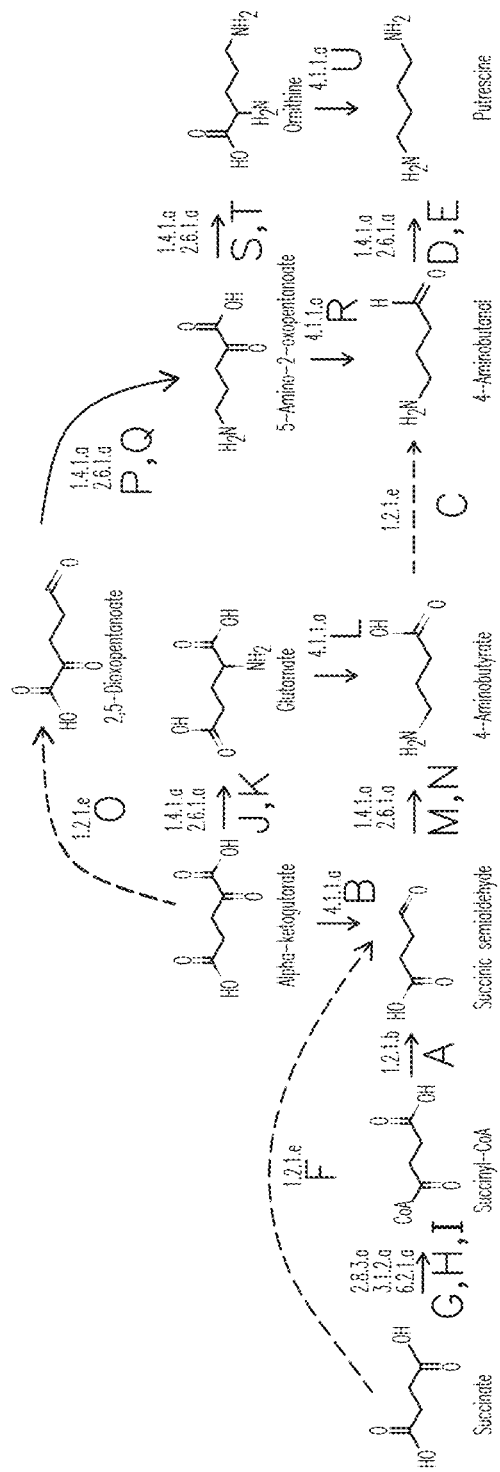
FIG. 63 shows pathways to putrescine from succinate, succcinyl-CoA, and alpha-ketoglutarate. Abbreviations: A) Succinyl-CoA reductase (aldehyde forming), B) Alpha-ketoglutarate decarboxylase, C) 4-Aminobutyrate reductase, D) Putrescine dehydrogenase, E) Putrescine transaminase, F) Succinate reductase, G) Succinyl-CoA transferase, H) Succinyl-CoA hydrolase, I) Succinyl-CoA synthetase (or Succinyl-CoA ligase), J) Glutamate dehydrogenase, K) Glutamate transaminase, L) Glutamate decarboxylase, M) 4-Aminobutyrate dehydrogenase, N) 4-Aminobutyrate transaminase, O) Alpha-ketoglutarate reductase, P) 5-Amino-2-oxopentanoate dehydrogenase, Q) 5-Amino-2-oxopentanoate transaminase, R) 5-Amino-2-oxopentanoate decarboxylase, S) Omithine dehydrogenase, T) Omithine transaminase, U) Omithine decarboxylase.

The invention additionally provides a non-naturally occurring microbial organism, comprising a putrescine pathway comprising at least one exogenous nucleic acid encoding a putrescine pathway enzyme expressed in a sufficient amount to produce putrescine, the putrescine pathway comprising succinate reductase; 4-aminobutyrate dehydrogenase or 4-aminobutyrate transaminase; 4-aminobutyrate reductase; and putrescine dehydrogenase or putrescine transaminase (see FIG. 63, steps F-M/N-C-D/E). In still another embodiment, the invention provides a non-naturally occurring microbial organism, comprising a putrescine pathway comprising at least one exogenous nucleic acid encoding a putrescine pathway enzyme expressed in a sufficient amount to produce putrescine, the putrescine pathway comprising alpha-ketoglutarate decarboxylase; 4-aminobutyrate dehydrogenase or 4-aminobutyrate transaminase; 4-aminobutyrate reductase; and putrescine dehydrogenase or putrescine transaminase (see FIG. 63, steps B-M/N-C-D/E). The invention additionally provides a non-naturally occurring microbial organism, comprising a putrescine pathway comprising at least one exogenous nucleic acid encoding a putrescine pathway enzyme expressed in a sufficient amount to produce putrescine, the putrescine pathway comprising glutamate dehydrogenase or glutamate transaminase; glutamate decarboxylase; 4-aminobutyrate reductase; and putrescine dehydrogenase or putrescine transaminase (see FIG. 63, steps J/K-L-C-D/E).

The invention provides in another embodiment a non-naturally occurring microbial organism, comprising a putrescine pathway comprising at least one exogenous nucleic acid encoding a putrescine pathway enzyme expressed in a sufficient amount to produce putrescine, the putrescine pathway comprising alpha-ketoglutarate reductase; 5-amino-2-oxopentanoate dehydrogenase or 5-amino-2-oxopentanoate transaminase; 5-amino-2-oxopentanoate decarboxylase; and putrescine dehydrogenase or putrescine transaminase (see FIG. 63, steps O-P/Q-R-D/E). Also provided is a non-naturally occurring microbial organism, comprising a putrescine pathway comprising at least one exogenous nucleic acid encoding a putrescine pathway enzyme expressed in a sufficient amount to produce putrescine, the putrescine pathway comprising alpha-ketoglutarate reductase; 5-amino-2-oxopentanoate dehydrogenase or 5-amino-2-oxopentanoate transaminase; ornithine dehydrogenase or ornithine transaminase; and ornithine decarboxylase (see FIG. 63, steps O-P/Q-S/T-U).

In an additional embodiment, the invention provides a non-naturally occurring microbial organism having a 4-HB, 4-HBal, 4-HBCoA, BDO or putrescine pathway, wherein the non-naturally occurring microbial organism comprises at least one exogenous nucleic acid encoding an enzyme or protein that converts a substrate of any of the pathways disclosed herein (see, for example, the Examples and FIGS. 1, 8-13, 58, 62, 63, 69 and 70). In an exemplary embodiment for producing BDO, the microbial organism can convert a substrate to a product selected from the group consisting of succinate to succinyl-CoA; succinyl-CoA to succinic semialdehyde; succinic semialdehyde to 4-hydroxybutrate; 4-hydroxybutyrate to 4-hydroxybutyryl-phosphate; 4-hydroxybutyryl-phosphate to 4-hydroxtbutyryl-CoA; 4-hydroxybutyryl-CoA to 4-hydroxybutanal; and 4-hydroxybutanal to 1,4-butanediol. In a pathway for producing 4-HBal, a microbial organism can convert, for example, succinate to succinic semialdehyde; succinic semialdehyde to 4-hydroxybutyrate; and 4-hydroxybutyrate to 4-hydroxybutanal. Such an organism can additionally include activity to convert 4-hydroxybutanal to 1,4-butanediol in order to produce BDO. Yet another pathway for producing 4-HBal can be, for example, alpha-ketoglutarate to succinic semialdehyde; succinic semialdehyde to 4-hydroxybutyrate; and 4-hydroxybutyrate to 4-hydroxybutanal. An alternative pathway for producing 4-HBal can be, for example, alpha-ketoglutarate to 2,5-dioxopentanoic acid; 2,5-dioxopentanoic acid to 5-hydroxy-2-oxopentanooic acid; and 5-hydroxy-2-oxopentanoic acid to 4-hydroxybutanal. An exemplary 4-hydroxybutyryl-CoA pathway can be, for example, alpha-ketoglutarate to 2,5-dioxopentanoic acid; 2,5-dioxopentanoic acid to 5-hydroxy-2-oxopentanoic acid; and 5-hydroxy-2-oxopentanoic acid to 4-hydroxybutyryl-CoA. An exemplary putrescine pathway can be, for example, succinate to succinyl-CoA; succinyl-CoA to succinic semialdehyde; succinic semialdehyde to 4-aminobutyrate; 4-aminobutyrate to 4-aminobutanal; and 4-aminobutanal to putrescine. An alternative putrescine pathway can be, for example, succinate to succinic semialdehyde; succinic semialdehyde to 4-aminobutyrate; 4-aminobutyrate to 4-aminobutanal; and 4-aminobutanal to putrescine. One skilled in the art will understand that these are merely exemplary and that any of the substrate-product pairs disclosed herein suitable to produce a desired product and for which an appropriate activity is available for the conversion can be readily determined by one skilled in the art based on the teachings herein. Thus, the invention provides a non-naturally occurring microbial organism containing at least one exogenous nucleic acid encoding an enzyme or protein, where the enzyme or protein converts the substrates and products of a pathway (see FIGS. 1, 8-13, 58, 62, 63, 69 and 70).

While generally described herein as a microbial organism that contains a 4-HB, 4-HBal, 4-HBCoA, BDO or putrescine pathway, it is understood that the invention additionally provides a non-naturally occurring microbial organism comprising at least one exogenous nucleic acid encoding a 4-HB, 4-HBal, 4-HBCoA, BDO or putrescine pathway enzyme or protein expressed in a sufficient amount to produce an intermediate of a 4-HB, 4-HBal, 4-HBCoA, BDO or putrescine pathway. For example, as disclosed herein, 4-HB, 4-HBal, 4-HBCoA, BDO and putrescine pathways are exemplified in FIGS. 1, 8-13, 58, 62, 63, 69 and 70. Therefore, in addition to a microbial organism containing for example, a BDO pathway that produces BDO, the invention additionally provides a non-naturally occurring microbial organism comprising at least one exogenous nucleic acid encoding a BDO pathway enzyme, where the microbial organism produces a BDO pathway intermediate as a product rather than an intermediate of the pathway. In one exemplary embodiment as shown in FIG. 62, for example, the invention provides a microbial organism that produces succinyl-CoA, succinic semialdehyde, 4-hydroxybutyrate, 4-hydroxybutyryl-phosphate, 4-hydroxybutyryl-CoA, or 4-hydroxybutanal as a product rather than an intermediate. Another exemplary embodiment includes, for example, a microbial organism that produces alpha-ketoglutarate, 2,5-dioxopentanoic acid, 5-hydroxy-2-oxopentanoic acid, or 4-hydroxybutanal as a product rather than an intermediate. An exemplary embodiment in a putrescine pathway includes, for example, a microbial organism that produces glutamate, 4-aminobutyrate, or 4-aminobutanal as a product rather than an intermediate. An alternative embodiment in a putrescine pathway can be, for example, a microbial organism that produces 2,5-dioxopentanoate, 5-amino-2-oxopentanoate, or ornithine as a product rather than an intermediate.

It is understood that any of the pathways disclosed herein, as described in the Examples and exemplified in the Figures, including the pathways of FIGS. 1, 8-13, 58, 62, 63, 69 and 70, can be utilized to generate a non-naturally occurring microbial organism that produces any pathway intermediate or product, as desired. As disclosed herein, such a microbial organism that produces an intermediate can be used in combination with another microbial organism expressing downstream pathway enzymes to produce a desired product. However, it is understood that a non-naturally occurring microbial organism that produces a 4-HB, 4-HBal, 4-HBCoA, BDO or putrescine pathway intermediate can be utilized to produce the intermediate as a desired product.

The invention is described herein with general reference to the metabolic reaction, reactant or product thereof, or with specific reference to one or more nucleic acids or genes encoding an enzyme associated with or catalyzing the referenced metabolic reaction, reactant or product. Unless otherwise expressly stated herein, those skilled in the art will understand that reference to a reaction also constitutes reference to the reactants and products of the reaction. Similarly, unless otherwise expressly stated herein, reference to a reactant or product also references the reaction and that reference to any of these metabolic constituents also references the gene or genes encoding the enzymes that catalyze the referenced reaction, reactant or product. Likewise, given the well known fields of metabolic biochemistry, enzymology and genomics, reference herein to a gene or encoding nucleic acid also constitutes a reference to the corresponding encoded enzyme and the reaction it catalyzes as well as the reactants and products of the reaction.

As disclosed herein, the product 4-hydroxybutyrate, as well as other intermediates, are carboxylic acids, which can occur in various ionized forms, including fully protonated, partially protonated, and fully deprotonated forms. Accordingly, the suffix "-ate," or the acid form, can be used interchangeably to describe both the free acid form as well as any deprotonated form, in particular since the ionized form is known to depend on the pH in which the compound is found. It is understood that carboxylate products or intermediates includes ester forms of carboxylate products or pathway intermediates, such as O-carboxylate and S-carboxylate esters. O- and S-carboxylates can include lower alkyl, that is C1 to C6, branched or straight chain carboxylates. Some such O- or S-carboxylates include, without limitation, methyl, ethyl, n-propyl, n-butyl, i-propyl, sec-butyl, and tert-butyl, pentyl, hexyl O- or S-carboxylates, any of which can further possess an unsaturation, providing for example, propenyl, butenyl, pentyl, and hexenyl O- or S-carboxylates. O-carboxylates can be the product of a biosynthetic pathway. Exemplary O-carboxylates accessed via biosynthetic pathways can include, without limitation, methyl 4-hydroxybutyrate, ethyl 4-hydroxybutyrate, and n-propyl 4-hydroxybutyrate. Other biosynthetically accessible O-carboxylates can include medium to long chain groups, that is C7-C22, O-carboxylate esters derived from fatty alcohols, such heptyl, octyl, nonyl, decyl, undecyl, lauryl, tridecyl, myristyl, pentadecyl, cetyl, palmitolyl, heptadecyl, stearyl, nonadecyl, arachidyl, heneicosyl, and behenyl alcohols, any one of which can be optionally branched and/or contain unsaturations. O-carboxylate esters can also be accessed via a biochemical or chemical process, such as esterification of a free carboxylic acid product or transesterification of an O- or S-carboxylate. S-carboxylates are exemplified by CoA S-esters, cysteinyl S-esters, alkylthio-esters, and various aryl and heteroaryl thioesters.

The production of 4-HB via biosynthetic modes using the microbial organisms of the invention is particularly useful because it can produce monomeric 4-HB. The non-naturally occurring microbial organisms of the invention and their biosynthesis of 4-HB and BDO family compounds also is particularly useful because the 4-HB product can be (1) secreted; (2) can be devoid of any derivatizations such as Coenzyme A; (3) avoids thermodynamic changes during biosynthesis; (4) allows direct biosynthesis of BDO, and (5) allows for the spontaneous chemical conversion of 4-HB to γ-butyrolactone (GBL) in acidic pH medium. This latter characteristic also is particularly useful for efficient chemical synthesis or biosynthesis of BDO family compounds such as 1,4-butanediol and/or tetrahydrofuran (THF), for example.

Microbial organisms generally lack the capacity to synthesize 4-HB and therefore any of the compounds disclosed herein to be within the 1,4-butanediol family of compounds or known by those in the art to be within the 1,4-butanediol family of compounds. Moreover, organisms having all of the requisite metabolic enzymatic capabilities are not known to produce 4-HB from the enzymes described and biochemical pathways exemplified herein. Rather, with the possible exception of a few anaerobic microorganisms described further below, the microorganisms having the enzymatic capability to use 4-HB as a substrate to produce, for example, succinate. In contrast, the non-naturally occurring microbial organisms of the invention can generate 4-HB, 4-HBal, 4-HBCoA, BDO and/or putrescine as a product. As described above, the biosynthesis of 4-HB in its monomeric form is not only particularly useful in chemical synthesis of BDO family of compounds, it also allows for the further biosynthesis of BDO family compounds and avoids altogether chemical synthesis procedures.

The non-naturally occurring microbial organisms of the invention that can produce 4-HB, 4-HBal, 4-HBCoA, BDO and/or putrescine are produced by ensuring that a host microbial organism includes functional capabilities for the complete biochemical synthesis of at least one 4-HB, 4-HBal, 4-HBCoA, BDO and/or putrscine biosynthetic pathway of the invention. Ensuring at least one requisite 4-HB, 4-HBal, 4-HBCoA or BDO biosynthetic pathway confers 4-HB biosynthesis capability onto the host microbial organism.

Several 4-HB biosynthetic pathways are exemplified herein and shown for purposes of illustration in FIG. 1. Additional 4-HB and BDO pathways are described in FIGS. 8-13. One 4-HB biosynthetic pathway includes the biosynthesis of 4-HB from succinate (the succinate pathway). The enzymes participating in this 4-HB pathway include CoA-independent succinic semialdehyde dehydrogenase and 4-hydroxybutanoate dehydrogenase. In this pathway, CoA-independent succinic semialdehyde dehydrogenase catalyzes the reverse reaction to the arrow shown in FIG. 1. Another 4-HB biosynthetic pathway includes the biosynthesis from succinate through succinyl-CoA (the succinyl-CoA pathway). The enzymes participating in this 4-HB pathway include succinyl-CoA synthetase, CoA-dependent succinic semialdehyde dehydrogenase and 4-hydroxybutanoate dehydrogenase. Three other 4-HB biosynthetic pathways include the biosynthesis of 4-HB from α-ketoglutarate (the α-ketoglutarate pathways). Hence, a third 4-HB biosynthetic pathway is the biosynthesis of succinic semialdehyde through glutamate: succinic semialdehyde transaminase, glutamate decarboxylase and 4-hydroxybutanoate dehydrogenase. A fourth 4-HB biosynthetic pathway also includes the biosynthesis of 4-HB from α-ketoglutarate, but utilizes α-ketoglutarate decarboxylase to catalyze succinic semialdehyde synthesis. 4-hydroxybutanoate dehydrogenase catalyzes the conversion of succinic semialdehyde to 4-HB. A fifth 4-HB biosynthetic pathway includes the biosynthesis from α-ketoglutarate through succinyl-CoA and utilizes α-ketoglutarate dehydrogenase to produce succinyl-CoA, which funnels into the succinyl-CoA pathway described above. Each of these 4-HB biosynthetic pathways, their substrates, reactants and products are described further below in the Examples. As described herein, 4-HB can further be biosynthetically converted to BDO by inclusion of appropriate enzymes to produce BDO (see Example). Thus, it is understood that a 4-HB pathway can be used with enzymes for converting 4-HB to BDO to generate a BDO pathway.

The non-naturally occurring microbial organisms of the invention can be produced by introducing expressible nucleic acids encoding one or more of the enzymes participating in one or more 4-HB, 4-HBal, 4-HBCoA, BDO or putrescine biosynthetic pathways. Depending on the host microbial organism chosen for biosynthesis, nucleic acids for some or all of a particular 4-HB, 4-HBal, 4-HBCoA, BDO or putrescine biosynthetic pathway can be expressed. For example, if a chosen host is deficient in one or more enzymes in a desired biosynthetic pathway, for example, the succinate to 4-HB pathway, then expressible nucleic acids for the deficient enzyme(s), for example, both CoA-independent succinic semialdehyde dehydrogenase and 4-hydroxybutanoate dehydrogenase in this example, are introduced into the host for subsequent exogenous expression. Alternatively, if the chosen host exhibits endogenous expression of some pathway enzymes, but is deficient in others, then an encoding nucleic acid is needed for the deficient enzyme(s) to achieve 4-HB, 4-HBal, 4-HBCoA, BDO or putrescine biosynthesis. For example, if the chosen host exhibits endogenous CoA-independent succinic semialdehyde dehydrogenase, but is deficient in 4-hydroxybutanoate dehydrogenase, then an encoding nucleic acid is needed for this enzyme to achieve 4-HB biosynthesis. Thus, a non-naturally occurring microbial organism of the invention can be produced by introducing exogenous enzyme or protein activities to obtain a desired biosynthetic pathway or a desired biosynthetic pathway can be obtained by introducing one or more exogenous enzyme or protein activities that, together with one or more endogenous enzymes or proteins, produces a desired product such as 4-HB, 4-HBal, 4-HBCoA, BDO and/or putrescine.

In like fashion, where 4-HB biosynthesis is selected to occur through the succinate to succinyl-CoA pathway (the succinyl-CoA pathway), encoding nucleic acids for host deficiencies in the enzymes succinyl-CoA synthetase, CoA-dependent succinic semialdehyde dehydrogenase and/or 4-hydroxybutanoate dehydrogenase are to be exogenously expressed in the recipient host. Selection of 4-HB biosynthesis through the α-ketoglutarate to succinic semialdehyde pathway (the α-ketoglutarate pathway) can utilize exogenous expression for host deficiencies in one or more of the enzymes for glutamate:succinic semialdehyde transaminase, glutamate decarboxylase and/or 4-hydroxybutanoate dehydrogenase, or α-ketoglutarate decarboxylase and 4-hydroxybutanoate dehydrogenase. One skilled in the art can readily determine pathway enzymes for production of 4-HB or BDO, as disclosed herein.

Depending on the 4-HB, 4-HBal, 4-HBCoA, BDO or putrescine biosynthetic pathway constituents of a selected host microbial organism, the non-naturally occurring microbial organisms of the invention will include at least one exogenously expressed 4-HB, 4-HB, 4-HBCoA, BDO or putrescine pathway-encoding nucleic acid and up to all encoding nucleic acids for one or more 4-HB or BDO biosynthetic pathways. For example, 4-HB, 4-HBal, 4-HBCoA, BDO or putrescine biosynthesis can be established in a host deficient in a pathway enzyme or protein through exogenous expression of the corresponding encoding nucleic acid. In a host deficient in all enzymes or proteins of a 4-HB, 4-HB, 4-HBCoA, BDO or putrescine pathway, exogenous expression of all enzyme or proteins in the pathway can be included, although it is understood that all enzymes or proteins of a pathway can be expressed even if the host contains at least one of the pathway enzymes or proteins. If desired, exogenous expression of all enzymes or proteins in a pathway for production of 4-HB, 4-HB, 4-HBCoA, BDO or putrescine can be included. For example, 4-HB biosynthesis can be established from all five pathways in a host deficient in 4-hydroxybutanoate dehydrogenase through exogenous expression of a 4-hydroxybutanoate dehydrogenase encoding nucleic acid. In contrast, 4-HB biosynthesis can be established from all five pathways in a host deficient in all eight enzymes through exogenous expression of all eight of CoA-independent succinic semialdehyde dehydrogenase, succinyl-CoA synthetase, CoA-dependent succinic semialdehyde dehydrogenase, glutamate:succinic semialdehyde transaminase, glutamate decarboxylase, α-ketoglutarate decarboxylase, α-ketoglutarate dehydrogenase and 4-hydroxybutanoate dehydrogenase.

Given the teachings and guidance provided herein, those skilled in the art will understand that the number of encoding nucleic acids to introduce in an expressible form will, at least, parallel 4-HB, 4-HBal, 4-HBCoA, BDO or putrescine pathway deficiencies of the selected host microbial organism. Therefore, a non-naturally occurring microbial organism of the invention can have one, two, three, four, five, six, seven, eight or up to all nucleic acids encoding the enzymes disclosed herein constituting one or more 4-HB, 4-HBal, 4-HBCoA, BDO or putrescine biosynthetic pathways. In some embodiments, the non-naturally occurring microbial organisms also can include other genetic modifications that facilitate or optimize 4-HB, 4-HBal, 4-HBCoA, BDO or putrescine biosynthesis or that confer other useful functions onto the host microbial organism. One such other functionality can include, for example, augmentation of the synthesis of one or more of 4-HB pathway precursors such as succinate, succinyl-CoA, α-ketoglutarate, 4-aminobutyrate, glutamate, acetoacetyl-CoA, and/or homoserine.

Generally, a host microbial organism is selected such that it produces the precursor of a 4-HB, 4-HBal, 4-HBCoA, BDO or putrescine pathway, either as a naturally produced molecule or as an engineered product that either provides de novo production of a desired precursor or increased production of a precursor naturally produced by the host microbial organism. For example, succinyl-CoA, α-ketoglutarate, 4-aminobutyrate, glutamate, acetoacetyl-CoA, and homoserine are produced naturally in a host organism such as *E. coli*. A host organism can be engineered to increase production of a precursor, as disclosed herein. In addition, a microbial organism that has been engineered to produce a desired precursor can be used as a host organism and further engineered to express enzymes or proteins of a 4-HB, 4-HBal, 4-HBCoA, BDO or putrescine pathway.

In some embodiments, a non-naturally occurring microbial organism of the invention is generated from a host that contains the enzymatic capability to synthesize 4-HB, 4-HBal, 4-HBCoA, BDO or putrescine. In this specific embodiment it can be useful to increase the synthesis or accumulation of a 4-HB, 4-HBal, 4-HBCoA, BDO or putrescine pathway product to, for example, drive 4-HB, 4-HBal, 4-HBCoA, BDO or putrescine pathway reactions toward 4-HB, 4-HBal, 4-HBCoA, BDO or putrescine production. Increased synthesis or accumulation can be accomplished by, for example, overexpression of nucleic acids encoding one or more of the 4-HB, 4-HBal, 4-HBCoA, BDO or putrescine pathway enzymes disclosed herein. Over expression of the 4-HB, 4-HBal, 4-HBCoA, BDO or putrescine pathway enzyme or enzymes can occur, for example, through exogenous expression of the endogenous gene or genes, or through exogenous expression of the heterologous gene or genes. Therefore, naturally occurring organisms can be readily generated to be non-naturally 4-HB, 4-HBal, 4-HBCoA, BDO or putrescine producing microbial organisms of the invention through overexpression of one, two, three, four, five, six and so forth up to all nucleic acids encoding 4-HB, 4-HBal, 4-HBCoA, BDO or putrescine biosynthetic pathway enzymes. In addition, a non-naturally occurring organism can be generated by mutagenesis of an endogenous gene that results in an increase in activity of an enzyme in the 4-HB, 4-HBal, 4-HBCoA, BDO or putrescine biosynthetic pathway.

In particularly useful embodiments, exogenous expression of the encoding nucleic acids is employed. Exogenous expression confers the ability to custom tailor the expression and/or regulatory elements to the host and application to achieve a desired expression level that is controlled by the user. However, endogenous expression also can be utilized in other embodiments such as by removing a negative regulatory effector or induction of the gene's promoter when linked to an inducible promoter or other regulatory element. Thus, an endogenous gene having a naturally occurring inducible promoter can be up-regulated by providing the appropriate inducing agent, or the regulatory region of an endogenous gene can be engineered to incorporate an inducible regulatory element, thereby allowing the regulation of increased expression of an endogenous gene at a desired time. Similarly, an inducible promoter can be included as a regulatory element for an exogenous gene introduced into a non-naturally occurring microbial organism (see Examples).

"Exogenous" as it is used herein is intended to mean that the referenced molecule or the referenced activity is introduced into the host microbial organism. The molecule can be introduced, for example, by introduction of an encoding nucleic acid into the host genetic material such as by integration into a host chromosome or as non-chromosomal genetic material such as a plasmid. Therefore, the term as it is used in reference to expression of an encoding nucleic acid refers to introduction of the encoding nucleic acid in an expressible form into the microbial organism. When used in reference to a biosynthetic activity, the term refers to an activity that is introduced into the host reference organism. The source can be, for example, a homologous or heterologous encoding nucleic acid that expresses the referenced activity following introduction into the host microbial organism. Therefore, the term "endogenous" refers to a referenced molecule or activity that is present in the host. Similarly, the term when used in reference to expression of an encoding nucleic acid refers to expression of an encoding nucleic acid contained within the microbial organism. The term "heterologous" refers to a molecule or activity derived from a source other than the referenced species whereas "homologous" refers to a molecule or activity derived from the host microbial organism. Accordingly, exogenous expression of an encoding nucleic acid of the invention can utilize either or both a heterologous or homologous encoding nucleic acid.

It is understood that when more than one exogenous nucleic acid is included in a microbial organism that the the more than one exogenous nucleic acids refers to the referenced encoding nucleic acid or biosynthetic activity, as discussed above. It is further understood, as disclosed herein, that such more than one exogenous nucleic acids can be introduced into the host microbial organism on separate nucleic acid molecules, on polycistronic nucleic acid molecules, or a combination thereof, and still be considered as more than one exogenous nucleic acid. For example, as disclosed herein a microbial organism can be engineered to express two or more exogenous nucleic acids encoding a desired pathway enzyme or protein. In the case where two exogenous nucleic acids encoding a desired activity are introduced into a host microbial organism, it is understood that the two exogenous nucleic acids can be introduced as a single nucleic acid, for example, on a single plasmid, on separate plasmids, can be integrated into the host chromosome at a single site or multiple sites, and still be considered as two exogenous nucleic acids. Similarly, it is understood that more than two exogenous nucleic acids can be introduced into a host organism in any desired combination, for example, on a single plasmid, on separate plasmids, can be integrated into the host chromosome at a single site or multiple sites, and still be considered as two or more exogenous nucleic acids, for example three exogenous nucleic acids. Thus, the number of referenced exogenous nucleic acids or biosynthetic activities refers to the number of encoding nucleic acids or the number of biosynthetic activities, not the number of separate nucleic acids introduced into the host organism.

As used herein, the term "gene disruption," or grammatical equivalents thereof, is intended to mean a genetic alteration that renders the encoded gene product inactive or attenuated. The genetic alteration can be, for example, deletion of the entire gene, deletion of a regulatory sequence required for transcription or translation, deletion of a portion of the gene which results in a truncated gene product, or by any of various mutation strategies that inactivate or attenuate the encoded gene product. One particularly useful method of gene disruption is complete gene deletion because it reduces or eliminates the occurrence of genetic reversions in the non-naturally occurring microorganisms of the invention. A gene disruption also includes a null mutation, which refers to a mutation within a gene or a region containing a gene that results in the gene not being transcribed into RNA and/or translated into a functional gene product. Such a null mutation can arise from many types of mutations including, for example, inactivating point mutations, deletion of a portion of a gene, entire gene deletions, or deletion of chromosomal segments.

As used herein, the term "attenuate," or grammatical equivalents thereof, is intended to mean to weaken, reduce or diminish the activity or amount of an enzyme or protein. Attenuation of the activity or amount of an enzyme or protein can mimic complete disruption if the attenuation causes the activity or amount to fall below a critical level required for a given pathway to function. However, the attenuation of the activity or amount of an enzyme or protein that mimics complete disruption for one pathway, can still be sufficient for a separate pathway to continue to function. For example, attenuation of an endogenous enzyme or protein can be sufficient to mimic the complete disruption of the same enzyme or protein for production of a 4-HB, 4-HBal, 4-HBCoA, BDO or putrescine of the invention, but the remaining activity or amount of enzyme or protein can still be sufficient to maintain other pathways, such as a pathway that is critical for the host microbial organism to survive, reproduce or grow. Attenuation of an enzyme or protein can also be weakening reducing or diminishing the activity or amount of the enzyme or protein in an amount that is sufficient to increase yield of a 4-HB, 4-HBal, 4-HBCoA, BDO or putrescine of the invention, but does not necessarily mimic complete disruption of the enzyme or protein.

As used herein, the term "growth-coupled" when used in reference to the production of a biochemical product is intended to mean that the biosynthesis of the referenced biochemical product is produced during the growth phase of a microorganism. In a particular embodiment, the growth-coupled production can optionally be obligatory, meaning that the biosynthesis of the referenced biochemical is an obligatory product produced during the growth phase of a microorganism.

Sources of encoding nucleic acids for a 4-HB, 4-HBal, 4-HBCoA, BDO or putrescine pathway enzyme can include, for example, any species where the encoded gene product is capable of catalyzing the referenced reaction. Such species include both prokaryotic and eukaryotic organisms including, but not limited to, bacteria, including archaea and eubacteria, and eukaryotes, including yeast, plant, insect, animal, and mammal, including human. Exemplary species for such sources include, for example, *Escherichia coli, Saccharomyces cerevisiae, Saccharomyces kuyveri, Clostridium kluyveri, Clostridium acetobutylicum, Clostridium beijerinckii, Clostridium saccharoperbuylacetonicum, Clostridium perfringens, Clostridium dificile, Clostridium botulinum, Clostridium tyrobutyricum, Clostridium tetanomorphum, Clostridium tetani, Clostridium propionicum, Clostridium aminobutyricum, Clostridium subterminale, Clostridium sticklandii, Ralstonia eutropha, Mycobacteriumn bovis, Mycobacterium tuberculosis, Porphyromonas gingivalis, Arabidopsis thaliana, Thermus thermophilus, Pseudomonas* species, including *Pseudomonas aeruginosa, Pseudomonas putida, Pseudomonas stutzeri, Pseudomonas fluorescens, Homo sapiens, Oryctolagus cuniculus, Rhodobacter paeroides, Thernmoanaerobacter brockii, Metallosphaera sedula, Leuconostoc mesenteroides, Chloroflexus rantiacus, Roseiflexus castenholzii, Erythrobacter, Simmondsia chinensis, Acinetobacter* species, including *Acinetobacter calcoaceticus* and *Acinetobacter baylyi, Porphyromonas gingivalis, Sulfolobus tokodaii, Sulfolobus solfataricus, Sulfolobus acidocaldarius, Bacillus subtilis, Bacillus cereus, Bacillus megaterium, Bacillus brevis, Bacillus purnilus, Rattus norvegicus, Klebsiella pneumonia, Klebsiella oxytoca, Euglena gracilis, Treponema denticola, Moorella thermoacetica, Thermotoga maritima, Halobacterium salinarum, Geobacillus stearothermophilus, Aeropyrum pernix, Sus scrofa, Caenorhabdiis elegmas, Corynebacterium glutamicum, Acidaminococcus fermentans, Lactococcus lactis, Lactobacillus plantarum, Streptococcus thermophilus, Enterobacter aerogenes, Candida, Aspergillus terreus, Pedicoccus pentosaceus, Zymomonas mobilis, Acetobacter pasteurians, Kluyveromyces lactis, Eubacterium barkeri, Bacteroides capillosus, Anaerotruncus colihominis, Natranaerobius thermophilum, Campylobacter jejuni, Haemophilus influenzae, Serratia marcescens, Citrobacter amaonaticus, Myxococcus xanthus, Fusobacterium numleatum, Penicillium chrysogenum,* marine gamma proteobacterium, butyrate-producing bacterium, *Nocardia iowensis, Nocardia farcinica, Streptomyces griseus, Schizosacchcaromyces pombe, Geobacillus thermoglucosidasius, Salmonella typhimurium, Vibrio cholera, Heliobacter pylori, Nicotiana tabacm, Oryza sativa, Haloferax mediterranei, Agrobacterium tumefaciens, Achromobacter denitrificans, Fusobacterium nucleatum, Streptomyces clavuligenus, Acinetobacter bawnanii, Mus musculus, Lachancea kluyveri, Trichomonas vaginalis, Trypanosoma brucei, Pseudomonas stutzeri, Bradyrhizobium japonicum, Mesorhizobium loti, Bos taurus, Nicotiana glutinosa, Vibrio vulnficus, Selenomonas ruminantium, Vibrio parahaemolyticus, Archaeoglobus fulgidus, Haloarcula marismortui, Pyrobaculum aerophilum, Mycobacterium smegmatis* MC2 155, *Mycobacterium avium* subsp. *paratuberculosis* K-10, *Mycobacterium marinum* M, *Tsukamurella paurometabola* DSM 20162, *Cyanobium* PCC7001, *Dictyostelium discoideum* AX4, and others disclosed herein (see Examples). For example, microbial organisms having 4-HB, 4-HBal, 4-HBCoA, BDO or putrescine biosynthetic production are exemplified herein with reference to *E. coli* and yeast hosts. However, with the complete genome sequence available for now more than 550 species (with more than half of these available on public databases such as the NCBI), including 395 microorganism genomes and a variety of yeast, fungi, plant, and mammalian genomes, the identification of genes encoding the requisite 4-HB, 4-HBal, 4-HBCoA, BDO or putrescine biosynthetic activity for one or more genes in related or distant species, including for example, homologues, orthologs, paralogs and nonorthologous gene displacements of known genes, and the interchange of genetic alterations between organisms is routine and well known in the art. Accordingly, the metabolic alterations allowing biosynthesis of 4-HB, 4-HBal, 4-HBCoA, BDO or putrescine and other compounds of the invention described herein with reference to a particular organism such as *E. coli* or yeast can be readily applied to other microorganisms, including prokaryotic and eukaryotic organisms alike. Given the teachings and guidance provided herein, those skilled in the art will know that a metabolic alteration exemplified in one organism can be applied equally to other organisms.

In some instances, such as when an alternative 4-HB, 4-HBal, BDO or putrescine biosynthetic pathway exists in an unrelated species, 4-HB, 4-HBal, BDO or putrescine biosynthesis can be conferred onto the host species by, for example, exogenous expression of a paralog or paralogs from the unrelated species that catalyzes a similar, yet non-identical metabolic reaction to replace the referenced reaction. Because certain differences among metabolic networks exist between different organisms, those skilled in the art will understand that the actual gene usage between different organisms may differ. However, given the teachings and guidance provided herein, those skilled in the art also will understand that the teachings and methods of the invention can be applied to all microbial organisms using the cognate metabolic alterations to those exemplified herein to construct a microbial organism in a species of interest that will synthesize 4-HB, such as monomeric 4-HB, 4-HBal, BDO or putrescine.

Host microbial organisms can be selected from, and the non-naturally occurring microbial organisms generated in, for example, bacteria, yeast, fungus or any of a variety of other microorganisms applicable to fermentation processes. Exemplary bacteria include any species selected from the order Enterobacteriales, family Enterobacteriaceae, including the genera *Escherichia* and *Klebsiella*; the order Aeromonadales, family Succinivibrionaceae, including the genus *Anaerobiospirillum*; the order Pasteurellales, family Pasteurellaceae, including the genera *Actinobacillus* and *Mannheimia*; the order Rhizobiales, family Bradyrhizobiaceae, including the genus *Rhizobium*; the order Bacillales, family Bacillaceae, including the genus *Bacillus*; the order Actinomycetales, families Corynebacteriaceae and Streptomycetaceae, including the genus *Corynebacterium* and the genus *Streptomyces*, respectively; order Rhodospirillales, family Acetobacteraceae, including the genus *Gluconobacter*; the order Sphingomonadales, family Sphingomonadaceae, including the genus *Zymomonas*; the order Lactobacillales, families Lactobacillaceae and Streptococcaceae, including the genus *Lactobacillus* and the genus *Lactococcus*, respectively; the order Clostridiales, family Clostridiaceae, genus *Clostridium*; and the order Pseudomonadales, family Pseudomonadaceae, including the genus *Pseudomonas*. Non-limiting species of host bacteria include *Escherichia coli, Klebsiella oxytoca, Anaerobiospirillum succiniciproducens, Actinobacillus succinogenes, Mannheimia succiniciproducens, Rhizobium etli, Bacillus subtilis, Corynebacterium glutamicum, Gluconobacter oxydans, Zymomonas mobilis, Lactococcus lactis, Lactobacillus plantarum, Streptomyces coelicolor, Clostridium acetobutylicum, Pseudomonas fluorescens,* and *Pseudomonas putida.*

Similarly, exemplary species of yeast or fungi species include any species selected from the order Saccharomycetales, family Saccaromycetaceae, including the genera *Saccharomyces, Kluyveromyces* and *Pichia*; the order Saccharomycetales, family Dipodascaceae, including the genus *Yarrowia*; the order Schizosaccharomycetales, family Schizosaccaromycetaceae, including the genus *Schizosaccharomyces*; the order Eurotiales, family Trichocomaceae, including the genus *Aspergillus*; and the order Mucorales, family Mucoraceae, including the genus *Rhizopus*. Non-limiting species of host yeast or fungi include *Saccharomyces cerevisiae, Schizosaccharomyces pombe, Kluyveromyces lactis, Kluyveromyces marxianus, Aspergillus terreus, Aspergillus niger, Pichia pastoris, Rhizopus arrhizus, Rhizopus oryzae, Yarrowia lipolytica,* and the like. *E. coli* is a particularly useful host organism since it is a well characterized microbial organism suitable for genetic engineering. Other particularly useful host organisms include yeast such as *Saccharomyces cerevisiae*. It is understood that any suitable microbial host organism can be used to introduce metabolic and/or genetic modifications to produce a desired product.

Methods for constructing and testing the expression levels of a non-naturally occurring 4-HB-, 4-HBal-, 4-HBCoA-, BDO-, or putrescine-producing host can be performed, for example, by recombinant and detection methods well known in the art. Such methods can be found described in, for example, Sambrook et al., *Molecular Cloning. A Laboratory Manual, Third Ed*, Cold Spring Harbor Laboratory, New York (2001); Ausubel et al., *Current Protocols in Molecular Biology*, John Wiley and Sons, Baltimore, MD (1999). 4-HB and GBL can be separated by, for example, HPLC using a Spherisorb 5 ODS1 column and a mobile phase of 70% 10 mM phosphate buffer (pH=7) and 30% methanol, and detected using a UV detector at 215 nm (Hennessy et al. 2004, J. Forensic Sci. 46(6):1-9). BDO is detected by gas chromatography or by HPLC and refractive index detector using an Aminex HPX-87H column and a mobile phase of 0.5 mM sulfuric acid (Gonzalez-Pajuelo et al., *Met. Eng.* 7:329-336 (2005)).

Exogenous nucleic acid sequences involved in a pathway for production of 4-HB, 4-HBal, 4-HBCoA, BDO or putrescine can be introduced stably or transiently into a host cell using techniques well known in the art including, but not limited to, conjugation, electroporation, chemical transformation, transduction, transfection, and ultrasound transformation. For exogenous expression in *E. coli* or other prokaryotic cells, some nucleic acid sequences in the genes or cDNAs of eukaryotic nucleic acids can encode targeting signals such as an N-terminal mitochondrial or other targeting signal, which can be removed before transformation into prokaryotic host cells, if desired. For example, removal of a mitochondrial leader sequence led to increased expression in *E. coli* (Hoffmeister et al., *J. Biol. Chem.* 280:4329-4338 (2005)). For exogenous expression in yeast or other eukaryotic cells, genes can be expressed in the cytosol without the addition of leader sequence, or can be targeted to mitochondrion or other organelles, or targeted for secretion, by the addition of a suitable targeting sequence such as a mitochondrial targeting or secretion signal suitable for the host cells. Thus, it is understood that appropriate modifications to a nucleic acid sequence to remove or include a targeting sequence can be incorporated into an exogenous nucleic acid sequence to impart desirable properties. Furthermore, genes can be subjected to codon optimization with techniques well known in the art to achieve optimized expression of the proteins.

An expression vector or vectors can be constructed to harbor one or more 4-HB, 4-HBal, 4-HBCoA, BDO or putrescine biosynthetic pathway and/or one or more biosynthetic encoding nucleic acids as exemplified herein operably linked to expression control sequences functional in the host organism. Expression vectors applicable for use in the microbial host organisms of the invention include, for example, plasmids, phage vectors, viral vectors, episomes and artificial chromosomes, including vectors and selection sequences or markers operable for stable integration into a host chromosome. Additionally, the expression vectors can include one or more selectable marker genes and appropriate expression control sequences. Selectable marker genes also can be included that, for example, provide resistance to antibiotics or toxins, complement auxotrophic deficiencies, or supply critical nutrients not in the culture media. Expression control sequences can include constitutive and inducible promoters, transcription enhancers, transcription terminators, and the like which are well known in the art. When two or more exogenous encoding nucleic acids are to be co-expressed, both nucleic acids can be inserted, for example, into a single expression vector or in separate expression vectors. For single vector expression, the encoding nucleic acids can be operationally linked to one common expression control sequence or linked to different expression control sequences, such as one inducible promoter and one constitutive promoter. The transformation of exogenous nucleic acid sequences involved in a metabolic or synthetic pathway can be confirmed using methods well known in the art. Such methods include, for example, nucleic acid analysis such as Northern blots or polymerase chain reaction (PCR) amplification of mRNA, or immunoblotting for expression of gene products, or other suitable analytical methods to test the expression of an introduced nucleic acid sequence or its corresponding gene product. It is understood by those skilled in the art that the exogenous nucleic acid is expressed in a sufficient amount to produce the desired product, and it is further understood that expression levels can be optimized to obtain sufficient expression using methods well known in the art and as disclosed herein.

The non-naturally occurring microbial organisms of the invention are constructed using methods well known in the art as exemplified herein to exogenously express at least one nucleic acid encoding a 4-HB, 4-HBal, 4-HBCoA, BDO or putrescine pathway enzyme in sufficient amounts to produce 4-HB, such as monomeric 4-HB, 4-HBal, 4-HBCoA, BDO or putrescine. It is understood that the microbial organisms of the invention are cultured under conditions sufficient to produce 4-HB, 4-HBal, 4-HBCoA, BDO or putrescine. Exemplary levels of expression for 4-HB, 4-HBal, 4-HBCoA, BDO or putrescine enzymes in each pathway are described further below in the Examples. Following the teachings and guidance provided herein, the non-naturally occurring microbial organisms of the invention can achieve biosynthesis of 4-HB, such as monomeric 4-HB, 4-HBal, 4-HBCoA, BDO or putrescine resulting in intracellular concentrations between about 0.1-200 mM or more, for example, 0.1-25 mM or more. Generally, the intracellular concentration of 4-HB, such as monomeric 4-HB, 4-HBal, 4-HBCoA, BDO or putrescine is between about 3-150 mM or more, particularly about 5-125 mM or more, and more particularly between about 8-100 mM, for example, about 3-20 mM, particularly between about 5-15 mM and more particularly between about 8-12 mM, including about 10 mM, 20 mM, 50 mM, 80 mM or more. Intracellular concentrations between and above each of these exemplary ranges also can be achieved from the non-naturally occurring microbial organisms of the invention. In particular embodiments, the microbial organisms of the invention, particularly strains such as those disclosed herein (see Examples XII-XIX and Table 18), can provide improved production of a desired product such as 4-HB, 4-HBal, 4-HBCoA, BDO or putrescine by increasing the production of 4-HB, 4-HBal, 4-HBCoA, BDO or putrescine and/or decreasing undesirable byproducts. Such production levels include, but are not limited to, those disclosed herein and including from about 1 gram to about 25 grams per liter, for example about 2, 3, 4, 5, 6, 7, 8, 9, 10, 11, 12, 13, 14, 15, 16, 17, 18, 19, 20, 21, 22, 23, 24, or even higher amounts of product per liter.

In addition to the culturing and fermentation conditions disclosed herein, growth condition for achieving biosynthesis of BDO, 4-HB, 4-HBCoA, 4-HBal and/or putrescine can include the addition of an osmoprotectant to the culturing conditions. In certain embodiments, the non-naturally occurring microbial organisms of the invention can be sustained, cultured or fermented as described herein in the presence of an osmoprotectant. Briefly, an osmoprotectant refers to a compound that acts as an osmolyte and helps a microbial organism as described herein survive osmotic stress. Osmoprotectants include, but are not limited to, betaines, amino acids, and the sugar trehalose. Non-limiting examples of such are glycine betaine, praline betaine, dimethylthetin, dimethylslfoniopropionate, 3-dimethylsulfonio-2-methylproprionate, pipecolic acid, dimethylsulfonioacetate, choline, L-carnitine and ectoine. In one aspect, the osmoprotectant is glycine betaine. It is understood to one of ordinary skill in the art that the amount and type of osmoprotectant suitable for protecting a microbial organism described herein from osmotic stress will depend on the microbial organism used. The amount of osmoprotectant in the culturing conditions can be, for example, no more than about 0.1 mM, no more than about 0.5 mM, no more than about 1.0 mM, no more than about 1.5 mM, no more than about 2.0 mM, no more than about 2.5 mM, no more than about 3.0 mM, no more than about 5.0 mM, no more than about 7.0 mM, no more than about 10 mM, no more than about 50 mM, no more than about 100 mM or no more than about 500 mM.

In some embodiments, culture conditions include anaerobic or substantially anaerobic growth or maintenance conditions. Exemplary anaerobic conditions have been described previously and are well known in the art. Exemplary anaerobic conditions for fermentation processes are described herein and are described, for example, in U.S. publication 2009/0047719, filed Aug. 10, 2007. Any of these conditions can be employed with the non-naturally occurring microbial organisms as well as other anaerobic conditions well known in the art. Under such anaerobic conditions or substantially anaerobic, the 4-HB, 4-HBal, 4-HBCoA, BDO or putrescine producers can synthesize 4-HB, 4-HBal, 4-HBCoA, BDO or putrescine at intracellular concentrations of 5-10 mM or more as well as all other concentrations exemplified herein. It is understood that, even though the above description refers to intracellular concentrations, 4-HB, 4-HBal, 4-HBCoA, BDO or putrescine producing microbial organisms can produce 4-HB, 4-HBal, 4-HBCoA, BDO or putrescine intracellularly and/or secrete the product into the culture medium.

Exemplary fermentation processes include, but are not limited to, fed-batch fermentation and batch separation; fed-batch fermentation and continuous separation; and continuous fermentation and continuous separation. In an exemplary batch fermentation protocol, the production organism is grown in a suitably sized bioreactor sparged with an appropriate gas. Under anaerobic conditions, the culture is sparged with an inert gas or combination of gases, for example, nitrogen, $N_2/CO_2$ mixture, argon, helium, and the like. As the cells grow and utilize the carbon source, additional carbon source(s) and/or other nutrients are fed into the bioreactor at a rate approximately balancing consumption of the carbon source and/or nutrients. The temperature of the bioreactor is maintained at a desired temperature, generally in the range of 22-37 degrees C., but the temperature can be maintained at a higher or lower temperature depending on the growth characteristics of the production organism and/or desired conditions for the fermentation process. Growth continues for a desired period of time to achieve desired characteristics of the culture in the fermenter, for example, cell density, product concentration, and the like. In a batch fermentation process, the time period for the fermentation is generally in the range of several hours to several days, for example, 8 to 24 hours, or 1, 2, 3, 4 or 5 days, or up to a week, depending on the desired culture conditions. The pH can be controlled or not, as desired, in which case a culture in which pH is not controlled will typically decrease to pH 3-6 by the end of the run. Upon completion of the cultivation period, the fermenter contents can be passed through a cell separation unit, for example, a centrifuge, filtration unit, and the like, to remove cells and cell debris. In the case where the desired product is expressed intracellularly, the cells can be lysed or disrupted enzymatically or chemically prior to or after separation of cells from the fermentation broth, as desired, in order to release additional product. The fermentation broth can be transferred to a product separations unit. Isolation of product occurs by standard separations procedures employed in the art to separate a desired product from dilute aqueous solutions. Such methods include, but are not limited to, liquid-liquid extraction using a water immiscible organic solvent (e.g, toluene or other suitable solvents, including but not limited to diethyl ether, ethyl acetate, tetrahydrofuran (THF), methylene chloride, chloroform, benzene, pentane, hexane, heptane, petroleum ether, methyl tertiary butyl ether (MTBE), dioxane, dimethylformamide (DMF), dimethyl sulfoxide (DMSO), and the like) to provide an organic solution of the product, if appropriate, standard distillation methods, and the like, depending on the chemical characteristics of the product of the fermentation process.

In an exemplary fully continuous fermentation protocol, the production organism is generally first grown up in batch mode in order to achieve a desired cell density. When the carbon source and/or other nutrients are exhausted, feed medium of the same composition is supplied continuously at a desired rate, and fermentation liquid is withdrawn at the same rate. Under such conditions, the product concentration in the bioreactor generally remains constant, as well as the cell density. The temperature of the fermenter is maintained at a desired temperature, as discussed above. During the continuous fermentation phase, it is generally desirable to maintain a suitable pH range for optimized production. The pH can be monitored and maintained using routine methods, including the addition of suitable acids or bases to maintain a desired pH range. The bioreactor is operated continuously for extended periods of time, generally at least one week to several weeks and up to one month, or longer, as appropriate and desired. The fermentation liquid and/or culture is monitored periodically, including sampling up to every day, as desired, to assure consistency of product concentration and/or cell density. In continuous mode, fermenter contents are constantly removed as new feed medium is supplied. The exit stream, containing cells, medium, and product, are generally subjected to a continuous product separations procedure, with or without removing cells and cell debris, as desired. Continuous separations methods employed in the art can be used to separate the product from dilute aqueous solutions, including but not limited to continuous liquid-liquid extraction using a water immiscible organic solvent (e.g., toluene or other suitable solvents, including but not limited to diethyl ether, ethyl acetate, tetrahydrofuran (THF), methylene chloride, chloroform, benzene, pentane, hexane, heptane, petroleum ether, methyl tertiary butyl ether (MTBE), dioxane, dimethylformamide (DMF), dimethyl sulfoxide (DMSO), and the like), standard continuous distillation methods, and the like, or other methods well known in the art.

In some embodiments, the carbon feedstock and other cellular uptake sources such as phosphate, ammonia, sulfate, chloride and other halogens can be chosen to alter the isotopic distribution of the atoms present in 4-HB, 4-HBal, 4-HBCoA, BDO or putrescine or any 4-HB, 4-HBal, 4-HB-CoA, BDO or putrescine pathway intermediate. The various carbon feedstock and other uptake sources enumerated above will be referred to herein, collectively, as "uptake sources." Uptake sources can provide isotopic enrichment for any atom present in the product 4-HB, 4-HBal, 4-HB-CoA, BDO or putrescine or 4-HB, 4-HBal, 4-HBCoA, BDO or putrescine pathway intermediate including any 4-HB, 4-HBal, 4-HBCoA, BDO or putrescine impurities generated in diverging away from the pathway at any point. Isotopic enrichment can be achieved for any target atom including, for example, carbon, hydrogen, oxygen, nitrogen, sulfur, phosphorus, chloride or other halogens.

In some embodiments, the uptake sources can be selected to alter the carbon-12, carbon-13, and carbon-14 ratios. In some embodiments, the uptake sources can be selected to alter the oxygen-16, oxygen-17, and oxygen-18 ratios. In some embodiments, the uptake sources can be selected to alter the hydrogen, deuterium, and tritium ratios. In some embodiments, the uptake sources can be selected to alter the nitrogen-14 and nitrogen-15 ratios. In some embodiments, the uptake sources can be selected to alter the sulfur-32, sulfur-33, sulfur-34, and sulfur-35 ratios. In some embodiments, the uptake sources can be selected to alter the phosphorus-31, phosphorus-32, and phosphorus-33 ratios. In some embodiments, the uptake sources can be selected to alter the chlorine-35, chlorine-36, and chlorine-37 ratios.

In some embodiments, the isotopic ratio of a target atom can be varied to a desired ratio by selecting one or more uptake sources. An uptake source can be derived from a natural source, as found in nature, or from a man-made source, and one skilled in the art can select a natural source, a man-made source, or a combination thereof, to achieve a desired isotopic ratio of a target atom. An example of a man-made uptake source includes, for example, an uptake source that is at least partially derived from a chemical synthetic reaction. Such isotopically enriched uptake sources can be purchased commercially or prepared in the laboratory and/or optionally mixed with a natural source of the uptake source to achieve a desired isotopic ratio. In some embodiments, a target atom isotopic ratio of an uptake source can be achieved by selecting a desired origin of the uptake source as found in nature. For example, as discussed herein, a natural source can be a biobased derived from or synthesized by a biological organism or a source such as petroleum-based products or the atmosphere. In some such embodiments, a source of carbon, for example, can be selected from a fossil fuel-derived carbon source, which can be relatively depleted of carbon-14, or an environmental or atmospheric carbon source, such as $CO_2$, which can possess a larger amount of carbon-14 than its petroleum-derived counterpart.

The unstable carbon isotope carbon-14 or radiocarbon makes up for roughly 1 in $10^{12}$ carbon atoms in the earth's atmosphere and has a half-life of about 5700 years. The stock of carbon is replenished in the upper atmosphere by a nuclear reaction involving cosmic rays and ordinary nitrogen ($^{14}N$). Fossil fuels contain no carbon-14, as it decayed long ago. Burning of fossil fuels lowers the atmospheric carbon-14 fraction, the so-called "Suess effect".

Methods of determining the isotopic ratios of atoms in a compound are well known to those skilled in the art. Isotopic enrichment is readily assessed by mass spectrometry using techniques known in the art such as accelerated mass spectrometry (AMS), Stable Isotope Ratio Mass Spectrometry (SIRMS) and Site-Specific Natural Isotopic Fractionation by Nuclear Magnetic Resonance (SNIF-NMR). Such mass spectral techniques can be integrated with separation techniques such as liquid chromatography (LC), high performance liquid chromatography (HPLC) and/or gas chromatography, and the like.

In the case of carbon, ASTM D6866 was developed in the United States as a standardized analytical method for determining the biobased content of solid, liquid, and gaseous samples using radiocarbon dating by the American Society for Testing and Materials (ASTM) International. The standard is based on the use of radiocarbon dating for the determination of a product's biobased content. ASTM D6866 was first published in 2004, and the current active version of the standard is ASTM D6866-11 (effective Apr. 1, 2011). Radiocarbon dating techniques are well known to those skilled in the art, including those described herein.

The biobased content of a compound is estimated by the ratio of carbon-14 ($^{14}C$) to carbon-12 (12C). Specifically, the Fraction Modern (Fm) is computed from the expression: Fm=(S−B)/(M−B), where B, S and M represent the $^{14}C/^{12}C$ ratios of the blank, the sample and the modern reference, respectively. Fraction Modern is a measurement of the deviation of the $^{14}C/^{12}C$ ratio of a sample from "Modern." Modern is defined as 95% of the radiocarbon concentration (in AD 1950) of National Bureau of Standards (NBS) Oxalic Acid I (i.e., standard reference materials (SRM) 4990b) normalized to $\delta^{13}C_{VPDB}$=−19 per mil. Olsson, *The use of Oxalic acid as a Standard*. in, *Radiocarbon Variations and Absolute Chronology*, Nobel Symposium, 12th Proc., John Wiley & Sons, New York (1970). Mass spectrometry results, for example, measured by ASM, are calculated using the internationally agreed upon definition of 0.95 times the specific activity of NBS Oxalic Acid I (SRM 4990b) normalized to $\delta^{13}C_{VPDB}$=−19 per mil. This is equivalent to an absolute (AD 1950)$^{14}C/^{12}C$ ratio of 1.176+0.010×10$^{12}$ (Karlen et al., *Arkiv Geofysik*, 4:465-471 (1968)). The standard calculations take into account the differential uptake of one isotope with respect to another, for example, the preferential uptake in biological systems of $C^{12}$ over $C^{13}$ over $C^{14}$, and these corrections are reflected as a Fm corrected for $\delta^{13}$.

An oxalic acid standard (SRM 4990b or HOx 1) was made from a crop of 1955 sugar beet. Although there were 1000 lbs made, this oxalic acid standard is no longer commercially available. The Oxalic Acid II standard (HOx 2; N.I.S.T designation SRM 4990 C) was made from a crop of 1977 French beet molasses. In the early 1980's, a group of 12 laboratories measured the ratios of the two standards. The ratio of the activity of Oxalic acid II to 1 is 1.2933+0.001 (the weighted mean). The isotopic ratio of HOx II is −17.8 per mille. ASTM D6866-11 suggests use of the available Oxalic Acid II standard SRM 4990 C (Hox2) for the modern standard (see discussion of original vs. currently available oxalic acid standards in Mann, *Radiocarbon*, 25(2):519-527 (1983)). AFm=0% represents the entire lack of carbon-14 atoms in a material, thus indicating a fossil (for example, petroleum based) carbon source. AFm=100%, after correction for the post-1950 injection of carbon-14 into the atmosphere from nuclear bomb testing indicates an entirely modern carbon source. As described herein, such a "modern" source includes biobased sources.

As described in ASTM D6866, the percent modern carbon (pMC) can be greater than 100% because of the continuing but diminishing effects of the 1950s nuclear testing programs, which resulted in a considerable enrichment of carbon-14 in the atmosphere as described in ASTM D6866-11. Because all sample carbon-14 activities are referenced to a "pre-bomb" standard, and because nearly all new biobased products are produced in a post-bomb environment, all pMC values (after correction for isotopic fraction) must be multiplied by 0.95 (as of 2010) to better reflect the true biobased content of the sample. A biobased content that is greater than 103% suggests that either an analytical error has occurred, or that the source of biobased carbon is more than several years old.

ASTM D6866 quantifies the biobased content relative to the material's total organic content and does not consider the inorganic carbon and other non-carbon containing substances present. For example, a product that is 50% starch-based material and 50% water would be considered to have a Biobased Content=100% (50% organic content that is 100%0 biobased) based on ASTM D6866. In another example, a product that is 50% starch-based material, 25% petroleum-based, and 25% water would have a Biobased Content=66.7% (75% organic content but only 50% of the product is biobased). In another example, a product that is 50% organic carbon and is a petroleum-based product would be considered to have a Biobased Content=0% (50% organic carbon but from fossil sources). Thus, based on the well known methods and known standards for determining the biobased content of a compound or material, one skilled in the art can readily determine the biobased content and/or prepared downstream products that utilize of the invention having a desired biobased content.

Applications of carbon-14 dating techniques to quantify bio-based content of materials are known in the art (Currie et al., *Nuclear Instruments and Methods in Physics Research B*, 172:281-287 (2000)). For example, carbon-14 dating has been used to quantify bio-based content in terephthalate-containing materials (Colonna et al., *Green Chemistry*, 13:2543-2548 (2011)). Notably, polypropylene terephthalate (PPT) polymers derived from renewable 1,3-propanediol and petroleum-derived terephthalic acid resulted in Fm values near 30% (i.e., since 3/11 of the polymeric carbon derives from renewable 1,3-propanediol and 8/11 from the fossil end member terephthalic acid) (Currie et al., supra, 2000). In contrast, polybutylene terephthalate polymer derived from both renewable 1,4-butanediol and renewable terephthalic acid resulted in bio-based content exceeding 90% (Colonna et al., supra, 2011).

Accordingly, in some embodiments, the present invention provides 4-HB, 4-HBal, 4-HBCoA, BDO or putrescine or a 4-HB, 4-HBal, 4-HBCoA, BDO or putrescine intermediate that has a carbon-12, carbon-13, and carbon-14 ratio that reflects an atmospheric carbon uptake source. For example, in some aspects the 4-HB, 4-HBal, 4-HBCoA, BDO or putrescine or a 4-HB, 4-HBal, 4-HBCoA, BDO or putrescine intermediate can have an Fm value of at least 10%, at least 15%, at least 20%, at least 25%, at least 30%, at least 35%, at least 40%, at least 45%, at least 50%/o, at least 55%, at least 60%, at least 65%, at least 70%, at least 75%, at least 80%, at least 85%, at least 90%, at least 95%, at least 98% or as much as 100%. In some such embodiments, the uptake source is $CO_2$. In some embodiments, the present invention provides 4-HB, 4-HBal, 4-HBCoA, BDO or putrescine or a 4-HB, 4-HBal, 4-HBCoA, BDO or putrescine intermediate that has a carbon-12, carbon-13, and carbon-14 ratio that reflects petroleum-based carbon uptake source. In this aspect, the 4-HB, 4-HBal, 4-HBCoA, BDO or putrescine or a 4-HB, 4-HBal, 4-HBCoA, BDO or putrescine intermediate can have an Fm value of less than 95%, less than 90%, less than 85%, less than 80%, less than 75%, less than 70%, less than 65%, less than 60%, less than 55%, less than 50%, less than 45%, less than 40%, less than 35%, less than 30%, less than 25%, less than 20%, less than 15%, less than 10%, less than 5%, less than 2% or less than 1%. In some embodiments, the present invention provides 4-HB, 4-HBal, 4-HB- CoA, BDO or putrescine or a 4-HB, 4-HBal, 4-HBCoA, BDO or putrescine intermediate that has a carbon-12, carbon-13, and carbon-14 ratio that is obtained by a combination of an atmospheric carbon uptake source with a petroleum-based uptake source. Using such a combination of uptake sources is one way by which the carbon-12, carbon-13, and carbon-14 ratio can be varied, and the respective ratios would reflect the proportions of the uptake sources.

Further, the present invention relates to the biologically produced 4-HB, 4-HBal, 4-HBCoA, BDO or putrescine or 4-HB, 4-HBal, 4-HBCoA, BDO or putrescine intermediate as disclosed herein, and to the products derived therefrom, wherein the 4-HB, 4-HBal, 4-HBCoA, BDO or putrescine or a 4-HB, 4-HBal, 4-HBCoA, BDO or putrescine intermediate has a carbon-12, carbon-13, and carbon-14 isotope ratio of about the same value as the $CO_2$ that occurs in the environment. For example, in some aspects the invention provides: bioderived 4-HB, 4-HBal, 4-HBCoA, BDO or putrescine or a bioderived 4-HB, 4-HBal, 4-HBCoA, BDO or putrescine intermediate having a carbon-12 versus carbon-13 versus carbon-14 isotope ratio of about the same value as the $CO_2$ that occurs in the environment, or any of the other ratios disclosed herein. It is understood, as disclosed herein, that a product can have a carbon-12 versus carbon-13 versus carbon-14 isotope ratio of about the same value as the $CO_2$ that occurs in the environment, or any of the ratios disclosed herein, wherein the product is generated from bioderived 4-HB, 4-HBal, 4-HBCoA, BDO or putrescine or a bioderived 4-HB, 4-HBal, 4-HBCoA, BDO or putrescine intermediate as disclosed herein, wherein the bioderived product is chemically modified to generate a final product. Methods of chemically modifying a bioderived product of 4-HB, 4-HBal, 4-HBCoA, BDO or putrescine, or an intermediate thereof, to generate a desired product are well known to those skilled in the art, as described herein. The invention further provides plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, nylons, and the like, having a carbon-12 versus carbon-13 versus carbon-14 isotope ratio of about the same value as the $CO_2$ that occurs in the environment, wherein the plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide)polybutylene terephthalate (PBT), and polyurethane-polyurea copolymers, referred to as spandex, elastane or Lycra™, and nylons are generated directly from or in combination with bioderived 4-HB, 4-HBal, 4-HBCoA, BDO or putrescine or a bioderived 4-HB, 4-HBal, 4-HBCoA, BDO or putrescine intermediate as disclosed herein.

The products 4-HB, 4-HBal, 4-HBCoA, BDO or putrescine are chemicals commonly used in many commercial and industrial applications. Non-limiting examples of such applications include production of plastics, elastic fibers, polyurethanes, polyesters, including polyhydroxyalkanoates such as poly-4-hydroxybutyrate (P4HB) or co-polymers thereof, poly(tetramethylene ether) glycol (PTMEG) (also referred to as PTMO, polytetramethylene oxide), polybutylene terephthalate (PBT), and polyurethane-polyurea copolymers, referred to as spandex, elastane or Lycra™, and nylons. Moreover, 4-HB, 4-HBal, 4-HBCoA, BDO or putrescine are also used as a raw material in the production of a wide range of products including plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, nylons. Accordingly, in some embodiments, the invention provides biobased plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, nylons comprising one or more bioderived 4-HB, 4-HBal, 4-HBCoA, BDO or putrescine or bioderived 4-HB, 4-HBal, 4-HBCoA, BDO or putrescine intermediate produced by a non-naturally occurring microorganism of the invention or produced using a method disclosed herein.

As used herein, the term "bioderived" means derived from or synthesized by a biological organism and can be considered a renewable resource since it can be generated by a biological organism. Such a biological organism, in particular the microbial organisms of the invention disclosed herein, can utilize feedstock or biomass, such as, sugars or carbohydrates obtained from an agricultural, plant, bacterial, or animal source. Alternatively, the biological organism can utilize atmospheric carbon. As used herein, the term "biobased" means a product as described above that is composed, in whole or in part, of a bioderived compound of the invention. A biobased or bioderived product is in contrast to a petroleum derived product, wherein such a product is derived from or synthesized from petroleum or a petrochemical feedstock.

In some embodiments, the invention provides plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, nylons comprising bioderived 4-HB, 4-HBal, 4-HBCoA, BDO or putrescine or bioderived 4-HB, 4-HBal, 4-HBCoA, BDO or putrescine intermediate, wherein the bioderived 4-HB, 4-HBal, 4-HBCoA, BDO or putrescine or bioderived 4-HB, 4-HBal, 4-HBCoA, BDO or putrescine intermediate includes all or part of the 4-HB, 4-HBal, 4-HBCoA, BDO or putrescine or 4-HB, 4-HBal, 4-HBCoA, BDO or putrescine intermediate used in the production of plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, and nylons. Thus, in some aspects, the invention provides a biobased plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, and nylons comprising at least 2%, at least 3%, at least 5%, at least 10%, at least 15%, at least 20%, at least 25%, at least 30%/o, at least 35%, at least 40%, at least 50%, at least 60%, at least 70%, at least 80%, at least 90%, at least 95%, at least 98% or 100% bioderived 4-HB, 4-HBal, 4-HBCoA, BDO or putrescine or bioderived 4-HB, 4-HBal, 4-HBCoA, BDO or putrescine intermediate as disclosed herein. Additionally, in some aspects, the invention provides a biobased plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, and nylons wherein the 4-HB, 4-HBal, 4-HBCoA, BDO or putrescine or 4-HB, 4-HBal, 4-HBCoA, BDO or putrescine intermediate used in its production is a combination of bioderived and petroleum derived 4-HB, 4-HBal, 4-HBCoA, BDO or putrescine or 4-HB, 4-HBal, 4-HBCoA, BDO or putrescine intermediate. For example, a biobased plastics, elastic fibers, polyurethanes, polyesters, including polyhydroxyalkanoates such as poly-4-hydroxybutyrate (P4HB) or co-polymers thereof, poly(tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, and nylons can be produced using 50% bioderived the 4-HB, 4-HBal, 4-HBCoA, BDO or putrescine and 50% petroleum derived 4-HB, 4-HBal, 4-HBCoA, BDO or putrescine or other desired ratios such as 60%/40%, 70%/30%, 80%/20%, 90%/10%, 95%/5%, 100%/0%, 40%/60%, 30%/70%, 20%/80%, 10%/90% of bioderived/petroleum derived precursors, so long as at least a portion of the product comprises a bioderived product produced by the microbial organisms disclosed herein. It is understood that methods for producing plastics, elastic fibers, polyurethanes, polyesters, including polyhydroxyalkanoates such as poly-4-hydroxybutyrate (P4HB) or co-polymers thereof, poly (tetramethylene ether) glycol (PTMEG)(also referred to as PTMO, polytetramethylene oxide), polybutylene terephthalate (PBT), and polyurethane-polyurea copolymers, referred to as spandex, elastane or Lycra™, and nylons using the bioderived 4-HB, 4-HBal, 4-HBCoA, BDO or putrescine or bioderived 4-HB, 4-HBal, 4-HBCoA, BDO or putrescine intermediate of the invention are well known in the art.

The invention additionally provides culture medium, which can be fermentation broth, comprising bioderived 4-hydroxybutyrate or 1,4-butanediol, or other products disclosed herein, for example, 4-HB, 4-HBal, 4-HBCoA, BDO or putrescine, wherein the bioderived product has a carbon-12, carbon-13 and carbon-14 isotope ratio that reflects an atmospheric carbon dioxide uptake source. Such culture medium can comprise bioderived products such as 4-HB, 4-HBal, 4-HBCoA, BDO or putrescine produced by a microbial organism of the invention as disclosed herein. In a particular embodiment, the culture medium can be separated from a non-naturally occurring microbial organism having a 4-HB, 4-HBal, 4-HBCoA, BDO or putrescine pathway, for example, a 4-hydroxybutyrate or 1,4-butanediol pathway. In another embodiment, the invention provides bioderived a 4-HB, 4-HBal, 4-HBCoA, BDO or putrescine, for example, 4-hydroxybutyrate or 1,4-butanediol, having a carbon-12, carbon-13 and carbon-14 isotope ratio that reflects an atmospheric carbon dioxide uptake source, for example, produced by a microbial organism of the invention. In a particular embodiment, the bioderived a 4-HB, 4-HBal, 4-HBCoA, BDO or putrescine, for example, 4-hydroxybutyrate or 1,4-butanediol, can have an Fm value of at least 80%, at least 85%, at least 90%, at least 95% or at least 98%. Such bioderived products of the invention can be produced by the microbial organisms or methods of the invention, as disclosed herein.

The invention further provides a composition comprising bioderived 4-HB, 4-HBal, 4-HBCoA, BDO or putrescine, for example, 4-hydroxybutyrate or 1,4-butanediol, and a compound other than the bioderived 4-HB, 4-HBal, 4-HBCoA, BDO or putrescine, for example, 4-hydroxybutyrate or 1,4-butanediol. The compound other than the bioderived product can be a cellular portion, for example, a trace amount of a cellular portion of, or can be fermentation broth or culture medium or a purified or partially purified fraction thereof produced in the presence of, a non-naturally occurring microbial organism of the invention having a 4-HB, 4-HBal, 4-HBCoA, BDO or putrescine, for example, for example, a 4-hydroxybutyrate or 1,4-butanediol pathway. The composition can comprise, for example, a reduced level of a byproduct when produced by an organism having reduced byproduct formation, as disclosed herein. The composition can comprise, for example, bioderived 4-HB, 4-HBal, 4-HBCoA, BDO or putrescine, for example, 4-hydroxybutyrate or 1,4-butanediol, or a cell lysate or culture supernatant of a microbial organism of the invention.

The invention additionally provides a biobased product comprising biobased 4-HB, 4-HBal, 4-HBCoA, BDO or putrescine, where the biobased product is a plastic, elastic fiber, polyurethane, polyester, polyhydroxyalkanoate, poly-4-hydroxybutyrate (P4HB), or a co-polymer thereof, poly (tetramethylene ether) glycol (PTMEG), polybutylene terephthalate (PBT), polyurethane-polyurea copolymer, or nylon. In one embodiment, the biobased product can comprise at least 5%, at least 10%, at least 20%, at least 30%, at least 40% or at least 50% bioderived 4-HB, 4-HBal, 4-HBCoA, BDO or putrescine, for example, 4-hydroxybutyrate or 1,4-butanediol. In another embodiment, a portion of the biobased product can comprise a portion of the bioderived 4-HB, 4-HBal, 4-HBCoA, BDO or putrescine, for example, 4-hydroxybutyrate or 1,4-butanediol, as a repeating unit, alone or in combination with other monomeric units to form a polymer. In another embodiment, the invention provides a molded product obtained by molding a biobased product such as a plastic, elastic fiber, polyurethane, polyester, polyhydroxyalkanoate, poly-4-hydroxybutyrate (P4HB), or a co-polymer thereof, poly(tetramethylene ether) glycol (PTMEG), polybutylene terephthalate (PBT), polyurethane-polyurea copolymer, or nylon, or other product as disclosed herein. The invention further provides a process for producing a biobased product by chemically reacting bioderived 4-HB, 4-HBal, 4-HBCoA, BDO or putrescine, for example, 4-hydroxybutyrate or 1,4-butanediol, with itself or another compound in a reaction that produces the biobased product. Such bioderived products of the invention can be produced by the microbial organisms or methods of the invention, as disclosed herein.

The culture conditions can include, for example, liquid culture procedures as well as fermentation and other large scale culture procedures. As described herein, particularly useful yields of the biosynthetic products of the invention can be obtained under anaerobic or substantially anaerobic culture conditions.

As described herein, one exemplary growth condition for achieving biosynthesis of 4-HB, 4-HBal, 4-HBCoA, BDO or putrescine includes anaerobic culture or fermentation conditions. In certain embodiments, the non-naturally occurring microbial organisms of the invention can be sustained, cultured or fermented under anaerobic or substantially anaerobic conditions. Briefly, anaerobic conditions refers to an environment devoid of oxygen. Substantially anaerobic conditions include, for example, a culture, batch fermentation or continuous fermentation such that the dissolved oxygen concentration in the medium remains between 0 and 10% of saturation. Substantially anaerobic conditions also includes growing or resting cells in liquid medium or on solid agar inside a sealed chamber maintained with an atmosphere of less than 1% oxygen. The percent of oxygen can be maintained by, for example, sparging the culture with an $N_2/CO_2$ mixture or other suitable non-oxygen gas or gases.

The invention also provides a non-naturally occurring microbial biocatalyst including a microbial organism having 4-hydroxybutanoic acid (4-HB) and 1,4-butanediol (BDO) biosynthetic pathways that include at least one exogenous nucleic acid encoding 4-hydroxybutanoate dehydrogenase, CoA-independent succinic semialdehyde dehydrogenase, succinyl-CoA synthetase, CoA-dependent succinic semialdehyde dehydrogenase, 4-hydroxybutyrate:CoA transferase, glutamate:succinic semialdehyde transaminase, glutamate decarboxylase, CoA-independent aldehyde dehydrogenase, CoA-dependent aldehyde dehydrogenase or alcohol dehydrogenase, wherein the exogenous nucleic acid is expressed in sufficient amounts to produce 1,4-butanediol (BDO). 4-Hydroxybutyrate:CoA transferase also is known as 4-hydroxybutyryl CoA:acetyl-CoA transferase. Additional 4-HB or BDO pathway enzymes are also disclosed herein (see Examples and FIGS. 8-13).

The invention further provides non-naturally occurring microbial biocatalyst including a microbial organism having 4-hydroxybutanoic acid (4-HB) and 1,4-butanediol (BDO) biosynthetic pathways, the pathways include at least one exogenous nucleic acid encoding 4-hydroxybutanoate dehydrogenase, succinyl-CoA synthetase, CoA-dependent succinic semialdehyde dehydrogenase, 4-hydroxybutyrate:CoA transferase, 4-butyrate kinase, phosphotransbutyrylase, α-ketoglutarate decarboxylase, aldehyde dehydrogenase, alcohol dehydrogenase or an aldehyde/alcohol dehydrogenase, wherein the exogenous nucleic acid is expressed in sufficient amounts to produce 1,4-butanediol (BDO).

Non-naturally occurring microbial organisms also can be generated which biosynthesize BDO. As with the 4-HB producing microbial organisms of the invention, the BDO producing microbial organisms also can produce intracellularly or secret the BDO into the culture medium. Following the teachings and guidance provided previously for the construction of microbial organisms that synthesize 4-HB, additional BDO pathways can be incorporated into the 4-HB producing microbial organisms to generate organisms that also synthesize BDO and other BDO family compounds. The chemical synthesis of BDO and its downstream products are known. The non-naturally occurring microbial organisms of the invention capable of BDO biosynthesis circumvent these chemical synthesis using 4-HB as an entry point as illustrated in FIG. 1. As described further below, the 4-HB producers also can be used to chemically convert 4-HB to GBL and then to BDO or THF, for example. Alternatively, the 4-HB producers can be further modified to include biosynthetic capabilities for conversion of 4-HB and/or GBL to BDO.

The additional BDO pathways to introduce into 4-HB producers include, for example, the exogenous expression in a host deficient background or the overexpression of one or more of the enzymes exemplified in FIG. 1 as steps 9-13. One such pathway includes, for example, the enzyme actives necessary to carryout the reactions shown as steps 9, 12 and 13 in FIG. 1, where the aldehyde and alcohol dehydrogenases can be separate enzymes or a multifunctional enzyme having both aldehyde and alcohol dehydrogenase activity. Another such pathway includes, for example, the enzyme activities necessary to carry out the reactions shown as steps 10, 11, 12 and 13 in FIG. 1, also where the aldehyde and alcohol dehydrogenases can be separate enzymes or a multifunctional enzyme having both aldehyde and alcohol dehydrogenase activity. Accordingly, the additional BDO pathways to introduce into 4-HB producers include, for example, the exogenous expression in a host deficient background or the overexpression of one or more of a 4-hydroxybutyrate: CoA transferase, butyrate kinase, phosphotransbutyrylase, CoA-independent aldehyde dehydrogenase, CoA-dependent aldehyde dehydrogenase or an alcohol dehydrogenase. In the absence of endogenous acyl-CoA synthetase capable of modifying 4-HB, the non-naturally occurring BDO producing microbial organisms can further include an exogenous acyl-CoA synthetase selective for 4-HB, or the combination of multiple enzymes that have as a net reaction conversion of 4-HB into 4-HB-CoA. As exemplified further below in the Examples, butyrate kinase and phosphotransbutyrylase exhibit BDO pathway activity and catalyze the conversions illustrated in FIG. 1 with a 4-HB substrate. Therefore, these enzymes also can be referred to herein as 4-hydroxybutyrate kinase and phosphotranshydroxybutyrylase respectively.

Exemplary alcohol and aldehyde dehydrogenases that can be used for these in vivo conversions from 4-HB to BDO are listed below in Table 1.

TABLE 1

Alcohol and Dehydrogenases for Conversion of 4-HB to BDO.

| ALCOHOL DEHYDROGENASES | |
|---|---|
| ec: 1.1.1.1 | alcohol dehydrogenase |
| ec: 1.1.1.2 | alcohol dehydrogenase (NADP+) |
| ec: 1.1.1.4 | (R,R)-butanediol dehydrogenase |
| ec: 1.1.1.5 | acetoin dehydrogenase |
| ec: 1.1.1.6 | glycerol dehydrogenase |
| ec: 1.1.1.7 | propanediol-phosphate dehydrogenase |
| ec: 1.1.1.8 | glycerol-3-phosphate dehydrogenase (NAD+) |
| ec: 1.1.1.11 | D-arabinitol 4-dehydrogenase |
| ec: 1.1.1.12 | L-arabinitol 4-dehydrogenase |
| ec: 1.1.1.13 | L-arabinitol 2-dehydrogenase |
| ec: 1.1.1.14 | L-iditol 2-dehydrogenase |
| ec: 1.1.1.15 | D-iditol 2-dehydrogenase |
| ec: 1.1.1.16 | galactitol 2-dehydrogenase |
| ec: 1.1.1.17 | mannitol-1-phosphate 5-dehydrogenase |
| ec: 1.1.1.18 | inositol 2-dehydrogenase |
| ec: 1.1.1.21 | reductase |
| ec: 1.1.1.23 | histidinol dehydrogenase |
| ec: 1.1.1.26 | glyoxylate reductase |
| ec: 1.1.1.27 | L-lactate dehydrogenase |
| ec: 1.1.1.28 | D-lactate dehydrogenase |
| ec: 1.1.1.29 | glycerate dehydrogenase |
| ec: 1.1.1.30 | 3-hydroxybutyrate dehydrogenase |
| ec: 1.1.1.31 | 3-hydroxyisobutyrate dehydrogenase |
| ec: 1.1.1.35 | 3-hydroxyacyl-CoA dehydrogenase |
| ec: 1.1.1.36 | acetoacetyl-CoA reductase |
| ec: 1.1.1.37 | malate dehydrogenase |
| ec: 1.1.1.38 | malate dehydrogenase (oxaloacetate-decarboxylating) |
| ec: 1.1.1.39 | malate dehydrogenase (decarboxylating) |
| ec: 1.1.1.40 | malate dehydrogenase (oxaloacetate-decarboxylating) (NADP+) |
| ec: 1.1.1.41 | isocitrate dehydrogenase (NAD+) |
| ec: 1.1.1.42 | isocitrate dehydrogenase (NADP+) |
| ec: 1.1.1.54 | allyl-alcohol dehydrogenase |
| ec: 1.1.1.55 | lactreductase (NADPH) |
| ec: 1.1.1.56 | ribitol 2-dehydrogenase |
| ec: 1.1.1.59 | 3-hydroxypropionate dehydrogenase |
| ec: 1.1.1.60 | 2-hydroxy-3-oxopropionate reductase |

TABLE 1-continued

Alcohol and Dehydrogenases for Conversion of 4-HB to BDO.

| ec: | | |
|---|---|---|
| ec: 1.1.1.61 | 4-hydroxybutyrate dehydrogenase |
| ec: 1.1.1.66 | omega-hydroxydecanoate dehydrogenase |
| ec: 1.1.1.67 | mannitol 2-dehydrogenase |
| ec: 1.1.1.71 | alcohol dehydrogenase [NAD(P)+] |
| ec: 1.1.1.72 | glycerol dehydrogenase (NADP+) |
| ec: 1.1.1.73 | octanol dehydrogenase |
| ec: 1.1.1.75 | (R)-aminopropanol dehydrogenase |
| ec: 1.1.1.76 | (S,S)-butanediol dehydrogenase |
| ec: 1.1.1.77 | lactreductase |
| ec: 1.1.1.78 | methylglyoxal reductase (NADH-dependent) |
| ec: 1.1.1.79 | glyoxylate reductase (NADP+) |
| ec: 1.1.1.80 | isopropanol dehydrogenase (NADP+) |
| ec: 1.1.1.81 | hydroxypyruvate reductase |
| ec: 1.1.1.82 | malate dehydrogenase (NADP+) |
| ec: 1.1.1.83 | D-malate dehydrogenase (decarboxylating) |
| ec: 1.1.1.84 | dimethylmalate dehydrogenase |
| ec: 1.1.1.85 | 3-isopropylmalate dehydrogenase |
| ec: 1.1.1.86 | ketol-acid reductoisomerase |
| ec: 1.1.1.87 | homoisocitrate dehydrogenase |
| ec: 1.1.1.88 | hydroxymethylglutaryl-CoA reductase |
| ec: 1.1.1.90 | aryl-alcohol dehydrogenase |
| ec: 1.1.1.91 | aryl-alcohol dehydrogenase (NADP+) |
| ec: 1.1.1.92 | oxaloglycolate reductase (decarboxylating) |
| ec: 1.1.1.94 | glycerol-3-phosphate dehydrogenase [NAD(P)+] |
| ec: 1.1.1.95 | phosphoglycerate dehydrogenase |
| ec: 1.1.1.97 | 3-hydroxybenzyl-alcohol dehydrogenase |
| ec: 1.1.1.101 | acylglycerone-phosphate reductase |
| ec: 1.1.1.103 | L-threonine 3-dehydrogenase |
| ec: 1.1.1.104 | 4-oxoproline reductase |
| ec: 1.1.1.105 | retinol dehydrogenase |
| ec: 1.1.1.110 | indolelactate dehydrogenase |
| ec: 1.1.1.112 | indanol dehydrogenase |
| ec: 1.1.1.113 | L-xylose 1-dehydrogenase |
| ec: 1.1.1.129 | L-threonate 3-dehydrogenase |
| ec: 1.1.1.137 | ribitol-5-phosphate 2-dehydrogenase |
| ec: 1.1.1.138 | mannitol 2-dehydrogenase (NADP+) |
| ec: 1.1.1.140 | sorbitol-6-phosphate 2-dehydrogenase |
| ec: 1.1.1.142 | D-pinitol dehydrogenase |
| ec: 1.1.1.143 | sequoyitol dehydrogenase |
| ec: 1.1.1.144 | perillyl-alcohol dehydrogenase |
| ec: 1.1.1.156 | glycerol 2-dehydrogenase (NADP+) |
| ec: 1.1.1.157 | 3-hydroxybutyryl-CoA dehydrogenase |
| ec: 1.1.1.163 | cyclopentanol dehydrogenase |
| ec: 1.1.1.164 | hexadecanol dehydrogenase |
| ec: 1.1.1.165 | 2-alkyn-1-ol dehydrogenase |
| ec: 1.1.1.166 | hydroxycyclohexanecarboxylate dehydrogenase |
| ec: 1.1.1.167 | hydroxymalonate dehydrogenase |
| ec: 1.1.1.174 | cyclohexane-1,2-diol dehydrogenase |
| ec: 1.1.1.177 | glycerol-3-phosphate 1-dehydrogenase (NADP+) |
| ec: 1.1.1.178 | 3-hydroxy-2-methylbutyryl-CoA dehydrogenase |
| ec: 1.1.1.185 | L-glycol dehydrogenase |
| ec: 1.1.1.190 | indole-3-acetreductase (NADH) |
| ec: 1.1.1.191 | indole-3-acetreductase (NADPH) |
| ec: 1.1.1.192 | long-chain-alcohol dehydrogenase |
| ec: 1.1.1.194 | coniferyl-alcohol dehydrogenase |
| ec: 1.1.1.195 | cinnamyl-alcohol dehydrogenase |
| ec: 1.1.1.198 | (+)-borneol dehydrogenase |
| ec: 1.1.1.202 | 1,3-propanediol dehydrogenase |
| ec: 1.1.1.207 | (−)-menthol dehydrogenase |
| ec: 1.1.1.208 | (+)-neomenthol dehydrogenase |
| ec: 1.1.1.216 | farnesol dehydrogenase |
| ec: 1.1.1.217 | benzyl-2-methyl-hydroxybutyrate dehydrogenase |
| ec: 1.1.1.222 | (R)-4-hydroxyphenyllactate dehydrogenase |
| ec: 1.1.1.223 | isopiperitenol dehydrogenase |
| ec: 1.1.1.226 | 4-hydroxycyclohexanecarboxylate dehydrogenase |
| ec: 1.1.1.229 | diethyl 2-methyl-3-oxosuccinate reductase |
| ec: 1.1.1.237 | hydroxyphenylpyruvate reductase |
| ec: 1.1.1.244 | methanol dehydrogenase |
| ec: 1.1.1.245 | cyclohexanol dehydrogenase |
| ec: 1.1.1.250 | D-arabinitol 2-dehydrogenase |
| ec: 1.1.1.251 | galactitol 1-phosphate 5-dehydrogenase |
| ec: 1.1.1.255 | mannitol dehydrogenase |
| ec: 1.1.1.256 | fluoren-9-ol dehydrogenase |
| ec: 1.1.1.257 | 4-(hydroxymethyl)benzenesulfonate dehydrogenase |
| ec: 1.1.1.258 | 6-hydroxyhexanoate dehydrogenase |
| ec: 1.1.1.259 | 3-hydroxypimeloyl-CoA dehydrogenase |
| ec: 1.1.1.261 | glycerol-1-phosphate dehydrogenase [NAD(P)+] |
| ec: 1.1.1.265 | 3-methylbutanal reductase |
| ec: 1.1.1.283 | methylglyoxal reductase (NADPH-dependent) |
| ec: 1.1.1.286 | isocitrate-homoisocitrate dehydrogenase |
| ec: 1.1.1.287 | D-arabinitol dehydrogenase (NADP+) |
| | butanol dehydrogenase |

ALDEHYDE DEHYDROGENASES

| ec: | | |
|---|---|---|
| ec: 1.2.1.2 | formate dehydrogenase |
| ec: 1.2.1.3 | aldehyde dehydrogenase (NAD+) |
| ec: 1.2.1.4 | aldehyde dehydrogenase (NADP+) |
| ec: 1.2.1.5 | aldehyde dehydrogenase [NAD(P)+] |
| ec: 1.2.1.7 | benzaldehyde dehydrogenase (NADP+) |
| ec: 1.2.1.8 | betaine-aldehyde dehydrogenase |
| ec: 1.2.1.9 | glyceraldehyde-3-phosphate dehydrogenase (NADP+) |
| ec: 1.2.1.10 | acetaldehyde dehydrogenase (acetylating) |
| ec: 1.2.1.11 | aspartate-semialdehyde dehydrogenase |
| ec: 1.2.1.12 | glyceraldehyde-3-phosphate dehydrogenase (phosphorylating) |
| ec: 1.2.1.13 | glyceraldehyde-3-phosphate dehydrogenase (NADP+) (phosphorylating) |
| ec: 1.2.1.15 | malonate-semialdehyde dehydrogenase |
| ec: 1.2.1.16 | succinate-semialdehyde dehydrogenase [NAD(P)+] |
| ec: 1.2.1.17 | glyoxylate dehydrogenase (acylating) |
| ec: 1.2.1.18 | malonate-semialdehyde dehydrogenase (acetylating) |
| ec: 1.2.1.19 | aminobutyraldehyde dehydrogenase |
| ec: 1.2.1.20 | glutarate-semialdehyde dehydrogenase |
| ec: 1.2.1.21 | glycolaldehyde dehydrogenase |
| ec: 1.2.1.22 | lactaldehyde dehydrogenase |
| ec: 1.2.1.23 | 2-oxoaldehyde dehydrogenase (NAD+) |
| ec: 1.2.1.24 | succinate-semialdehyde dehydrogenase |
| ec: 1.2.1.25 | 2-oxoisovalerate dehydrogenase (acylating) |
| ec: 1.2.1.26 | 2,5-dioxovalerate dehydrogenase |
| ec: 1.2.1.27 | methylmalonate-semialdehyde dehydrogenase (acylating) |
| ec: 1.2.1.28 | benzaldehyde dehydrogenase (NAD+) |
| ec: 1.2.1.29 | aryl-aldehyde dehydrogenase |
| ec: 1.2.1.30 | aryl-aldehyde dehydrogenase (NADP+) |
| ec: 1.2.1.31 | L-aminoadipate-semialdehyde dehydrogenase |
| ec: 1.2.1.32 | aminomuconate-semialdehyde dehydrogenase |

TABLE 1-continued

Alcohol and Dehydrogenases for Conversion of 4-HB to BDO.

| ec: | Name |
|---|---|
| 1.2.1.36 | retinal dehydrogenase |
| 1.2.1.39 | phenylacetaldehyde dehydrogenase |
| 1.2.1.41 | glutamate-5-semialdehyde dehydrogenase |
| 1.2.1.42 | hexadecanal dehydrogenase (acylating) |
| 1.2.1.43 | formate dehydrogenase (NADP+) |
| 1.2.1.45 | 4-carboxy-2-hydroxymuconate-6-semialdehyde dehydrogenase |
| 1.2.1.46 | formaldehyde dehydrogenase |
| 1.2.1.47 | 4-trimethylammoniobutyraldehyde dehydrogenase |
| 1.2.1.48 | long-chain-aldehyde dehydrogenase |
| 1.2.1.49 | 2-oxoaldehyde dehydrogenase (NADP+) |
| 1.2.1.51 | pyruvate dehydrogenase (NADP+) |
| 1.2.1.52 | oxoglutarate dehydrogenase (NADP+) |
| 1.2.1.53 | 4-hydroxyphenylacetaldehyde dehydrogenase |
| 1.2.1.57 | butanal dehydrogenase |
| 1.2.1.58 | phenylglyoxylate dehydrogenase (acylating) |
| 1.2.1.59 | glyceraldehyde-3-phosphate dehydrogenase (NAD(P)+) (phosphorylating) |
| 1.2.1.62 | 4-formylbenzenesulfonate dehydrogenase |
| 1.2.1.63 | 6-oxohexanoate dehydrogenase |
| 1.2.1.64 | 4-hydroxybenzaldehyde dehydrogenase |
| 1.2.1.65 | salicylaldehyde dehydrogenase |
| 1.2.1.66 | mycothiol-dependent formaldehyde dehydrogenase |
| 1.2.1.67 | vanillin dehydrogenase |
| 1.2.1.68 | coniferyl-aldehyde dehydrogenase |
| 1.2.1.69 | fluoroacetaldehyde dehydrogenase |
| 1.2.1.71 | succinylglutamate-semialdehyde dehydrogenase |

Other exemplary enzymes and pathways are disclosed herein (see Examples). Furthermore, it is understood that enzymes can be utilized for carry out reactions for which the substrate is not the natural substrate. While the activity for the non-natural substrate may be lower than the natural substrate, it is understood that such enzymes can be utilized, either as naturally occurring or modified using the directed evolution or adaptive evolution, as disclosed herein (see also Examples).

BDO production through any of the pathways disclosed herein are based, in part, on the identification of the appropriate enzymes for conversion of precursors to BDO. A number of specific enzymes for several of the reaction steps have been identified. For those transformations where enzymes specific to the reaction precursors have not been identified, enzyme candidates have been identified that are best suited for catalyzing the reaction steps. Enzymes have been shown to operate on a broad range of substrates, as discussed below. In addition, advances in the field of protein engineering also make it feasible to alter enzymes to act efficiently on substrates, even if not a natural substrate. Described below are several examples of broad-specificity enzymes from diverse classes suitable for a BDO pathway as well as methods that have been used for evolving enzymes to act on non-natural substrates.

A key class of enzymes in BDO pathways is the oxidoreductases that interconvert ketones or aldehydes to alcohols (1.1.1). Numerous exemplary enzymes in this class can operate on a wide range of substrates. An alcohol dehydrogenase (1.1.1.1) purified from the soil bacterium *Brevibacterium* sp KU 1309 (Hirano et al., *J. Biosc. Bioeng.* 100: 318-322 (2005)) was shown to operate on a plethora of aliphatic as well as aromatic alcohols with high activities. Table 2 shows the activity of the enzyme and its $K_m$ on different alcohols. The enzyme is reversible and has very high activity on several aldehydes also (Table 3).

TABLE 2

Relative activities of an alcohol dehydrogenase from *Brevibacterium* sp KU to oxidize various alcohols.

| Substrate | Relative Activity (0%) | $K_m$ (mM) |
|---|---|---|
| 2-Phenylethanol | 100* | 0.025 |
| (S)-2-Phenylpropanol | 156 | 0.157 |
| (R)-2-Phenylpropanol | 63 | 0.020 |
| Bynzyl alcohol | 199 | 0.012 |
| 3-Phenylpropanol | 135 | 0.033 |
| Ethanol | 76 | |
| 1-Butanol | 111 | |
| 1-Octanol | 101 | |
| 1-Dodecanol | 68 | |
| 1-Phenylethanol | 46 | |
| 2-Propanol | 54 | |

*The activity of 2-phenylethanol, corresponding to 19.2 U/mg, was taken as 100%.

TABLE 3

Relative activities of an alcohol dehydrogenase from *Brevibacterium* sp KU 1309 to reduce various carbonyl compounds.

| Substrate | Relative Activity (%) | $K_m$ (mM) |
|---|---|---|
| Phenylacetaldehyde | 100 | 0.261 |
| 2-Phenylpropionaldehyde | 188 | 0.864 |
| 1-Octylaldehyde | 87 | |
| Acetophenone | 0 | |

Lactate dehydrogenase (1.1.1.27) from *Ralstonia eutropha* is another enzyme that has been demonstrated to have high activities on several 2-oxoacids such as 2-oxobutyrate, 2-oxopentanoate and 2-oxoglutarate (a C5 compound analogous to 2-oxoadipate) (Steinbuchel and Schlegel, *Eur. J. Biochem.* 130:329-334 (1983)). Column 2 in Table 4 demonstrates the activities of ldhA from *R. eutropha* (formerly *A. eutrophus*) on different substrates (Steinbuchel and Schlegel, supra, 1983).

TABLE 4

The in vitro activity of *R. eutropha* ldhA (Steinbuchel and Schlegel, supra, 1983) on different substrates and compared with that on pyruvate.

| | Activity (%) of | | |
|---|---|---|---|
| Substrate | L(+)-lactate dehydrogenase from *A. eutrophus* | L(+)-lactate dehydrogenase from rabbit muscle | D(−)-lactate dehydrogenase from *L. leichmanii* |
| Glyoxylate | 8.7 | 23.9 | 5.0 |
| Pyruvate | 100.0 | 100.0 | 100.0 |
| 2-Oxobutyrate | 107.0 | 18.6 | 1.1 |
| 2-Oxovalerate | 125.0 | 0.7 | 0.0 |
| 3-Methyl-2-oxobutyrate | 28.5 | 0.0 | 0.0 |
| 3-Methyl-2-oxovalerate | 5.3 | 0.0 | 0.0 |

TABLE 4-continued

The in vitro activity of R. eutropha ldhA (Steinbuchel and Schlegel, supra, 1983) on different substrates and compared with that on pyruvate.

| Substrate | Activity (%) of | | |
|---|---|---|---|
| | L(+)-lactate dehydrogenase from A. eutrophus | L(+)-lactate dehydrogenase from rabbit muscle | D(−)-lactate dehydrogenase from L. leichmanii |
| 4-Methyl-2-oxopentanoate | 39.0 | 1.4 | 1.1 |
| Oxaloacetate | 0.0 | 33.1 | 23.1 |
| 2-Oxoglutarate | 79.6 | 0.0 | 0.0 |
| 3-Fluoropyruvate | 33.6 | 74.3 | 40.0 |

Oxidoreductases that can convert 2-oxoacids to their acyl-CoA counterparts (1.2.1) have been shown to accept multiple substrates as well. For example, branched-chain 2-keto-acid dehydrogenase complex (BCKAD), also known as 2-oxoisovalerate dehydrogenase (1.2.1.25), participates in branched-chain amino acid degradation pathways, converting 2-keto acids derivatives of valine, leucine and isoleucine to their acyl-CoA derivatives and $CO_2$. In some organisms including Rattus norvegicus (Paxton et al., Biochem. J. 234:295-303 (1986)) and Saccharomyces cerevisiae (Sinclair et al., Biochem. Mol Biol. Int. 32:911-922 (1993), this complex has been shown to have a broad substrate range that includes linear oxo-acids such as 2-oxobutanoate and alpha-ketoglutarate, in addition to the branched-chain amino acid precursors.

Members of yet another class of enzymes, namely aminotransferases (2.6.1), have been reported to act on multiple substrates. Aspartate aminotransferase (aspAT) from Pyrococcus fursious has been identified, expressed in E. coli and the recombinant protein characterized to demonstrate that the enzyme has the highest activities towards aspartate and alpha-ketoglutarate but lower, yet significant activities towards alanine, glutamate and the aromatic amino acids (Ward et al., Archaea 133-141 (2002)). In another instance, an aminotransferase indentified from Leishmania mexicana and expressed in E. coli (Vernal et al., FEMS Microbiol. Lett. 229:217-222 (2003)) was reported to have a broad substrate specificity towards tyrosine (activity considered 100% on tyrosine), phenylalanine (90%), tryptophan (85%), aspartate (30%), leucine (25%) and methionine (25%), respectively (Vernal et al., Mol. Biochem. Parasitol 196:83-92 (1998)). Similar broad specificity has been reported for a tyrosine aminotransferase from Trypanosoma cruzi, even though both of these enzymes have a sequence homology of only 6%. The latter enzyme can accept leucine, methionine as well as tyrosine, phenylalanine, tryptophan and alanine as efficient amino donors (Nowicki et al., Biochim. Biophys. Acta 1546: 268-281 (2001)).

CoA transferases (2.8.3) have been demonstrated to have the ability to act on more than one substrate. Specifically, a CoA transferase was purified from Clostridium acetobutylicum and was reported to have the highest activities on acetate, propionate, and butyrate. It also had significant activities with valerate, isobutyrate, and crotonate (Wiesenborn et al., Appl. Environ. Microbiol. 55:323-329 (1989)). In another study, the E. coli enzyme acyl-CoA:acetate-CoA transferase, also known as acetate-CoA transferase (EC 2.8.3.8), has been shown to transfer the CoA moiety to acetate from a variety of branched and linear acyl-CoA substrates, including isobutyrate (Matthies and Schink, App. Environm. Microbiol. 58:1435-1439 (1992)), valerate (Vanderwinkel et al., Biochem. Biophys. Res Commun 33:902-908 (1968b)) and butanoate (Vanderwinkel et al., Biochem. Biophys. Res Commun. 33:902-908(1968a).

Other enzyme classes additionally support broad substrate specificity for enzymes. Some isomerases (5.3.3) have also been proven to operate on multiple substrates. For example, L-rhamnose isomerase from Pseudomonas stutzeri catalyzes the isomerization between various aldoalses and ketoses (Yoshida et al., J. Mol. Biol. 365:1505-1516 (2007)). These include isomerization between L-rhamnose and L-rhamnulose, L-mannose and L-fructose, L-xylose and L-xylulose, D-ribose and D-ribulose, and D-allose and D-psicose.

In yet another class of enzymes, the phosphotransferases (2.7.1), the homoserine kinase (2.7.1.39) from E. coli that converts L-homoserine to L-homoserine phosphate, was found to phosphorylate numerous homoserine analogs. In these substrates, the carboxyl functional group at the R-position had been replaced by an ester or by a hydroxymethyl group (Huo and Viola, Biochemistry 35:16180-16185 (1996)). Table 5 demonstrates the broad substrate specificity of this kinase.

TABLE 5

The substrate specificity of homoserine kinase.

| Substrate | $k_{cat}$ | % $k_{cat}$ | $K_m$ (mM) | $k_{cat}/K_m$ |
|---|---|---|---|---|
| L-homoserine | 18.3 ± 0.1 | 100 | 0.14 ± 0.04 | 184 ± 17 |
| D-homoserine | 8.3 ± 1.1 | 32 | 31.8 ± 7.2 | 0.26 ± 0.03 |
| L-aspartate β-semialdehyde | 2.1 ± 0.1 | 8.2 | 0.28 ± 0.02 | 7.5 ± 0.3 |
| L-2-amino-1,4-butanediol | 2.0 ± 0.5 | 7.9 | 11.6 ± 6.5 | 0.17 ± 0.06 |
| L-2-amino-5-hydroxyvalerate | 2.5 ± 0.4 | 9.9 | 1.1 ± 0.5 | 2.3 ± 0.3 |
| L-homoserine methyl ester | 14.7 ± 2.6 | 80 | 4.9 ± 2.0 | 3.0 ± 0.6 |
| L-homoserine ethyl ester | 13.6 ± 0.8 | 74 | 1.9 ± 0.5 | 7.2 ± 1.7 |
| L-homoserine isopropyl ester | 13.6 ± 1.4 | 74 | 1.2 ± 0.5 | 11.3 ± 1.1 |
| L-homoserine n-propyl ester | 14.0 ± 0.4 | 76 | 3.5 ± 0.4 | 4.0 ± 1.2 |
| L-homoserine isobutyl ester | 16.4 ± 0.8 | 84 | 6.9 ± 1.1 | 2.4 ± 0.3 |
| L-homserine n-butyl ester | 29.1 ± 1.2 | 160 | 5.8 ± 0.8 | 5.0 ± 0.5 |

Another class of enzymes useful in BDO pathways is the acid-thiol ligases (6.2.1). Like enzymes in other classes, certain enzymes in this class have been determined to have broad substrate specificity. For example, acyl CoA ligase from Pseudomonas putida has been demonstrated to work on several aliphatic substrates including acetic, propionic, butyric, valeric, hexanoic, heptanoic, and octanoic acids and on aromatic compounds such as phenylacetic and phenoxyacetic acids (Femandez-Valverde et al., Appl. Environ Microbiol. 59:1149-1154 (1993)). A related enzyme, malonyl CoA synthetase (6.3.4.9) from Rhizobium trifolii could convert several diacids, namely, ethyl-, propyl-, allyl-, isopropyl-, dimethyl-, cyclopropyl-, cyclopropylmethylene-, cyclobutyl-, and benzyl-malonate into their corresponding monothioesters (Pohl et al., J. Am. Chem. Soc. 123:5822-5823 (2001)). Similarly, decarboxylases (4.1.1) have also been found with broad substrate ranges. Pyruvate decarboxylase (PDC), also termed keto-acid decarboxylase, is a key enzyme in alcoholic fermentation, catalyzing the decarboxylation of pyruvate to acetaldehyde. The enzyme isolated from Saccharomyces cerevisiae has a broad substrate range for aliphatic 2-keto acids including 2-ketobutyrate, 2-ketovalerate, and 2-phenylpyruvate (Li and Jordan, *Biochemistry* 38:10004-10012 (1999)). Similarly, benzoylformate decarboxylase has a broad substrate range and has been the target of enzyme engineering studies. The enzyme from *Pseudomonas putida* has been extensively studied and crystal structures of this enzyme are available (Polovnikova et al., *Biochemistry* 42:1820-1830 (2003); Hasson et al., *Biochemistry* 37:9918-9930 (1998)). Branched chain alpha-ketoacid decarboxylase (BCKA) has been shown to act on a variety of compounds varying in chain length from 3 to 6 carbons (Oku and Kaneda, *J. Biol. Chem.* 263:18386-18396 (1998); Smit et al., *Appl. Environ. Microbiol.* 71:303-311 (2005b)). The enzyme in *Lactococcus lactis* has been characterized on a variety of branched and linear substrates including 2-oxobutanoate, 2-oxohexanoate, 2-oxopentanoate, 3-methyl-2-oxobutanoate, 4-methyl-2-oxobutanoate and isocaproate (Smit et al., *Appl. Environ. Microbiol.* 71:303-311 (2005a).

Interestingly, enzymes known to have one dominant activity have also been reported to catalyze a very different function. For example, the cofactor-dependent phosphoglycerate mutase (5.4.2.1) from *Bacillus stearothermophilus* and *Bacillus subtilis* is known to function as a phosphatase as well (Rigden et al., *Protein Sci.* 10:1835-1846 (2001)). The enzyme from *B. stearothermophilus* is known to have activity on several substrates, including 3-phosphoglycerate, alpha-napthylphosphate, p-nitrophenylphosphate, AMP, fructose-6-phosphate, ribose-5-phosphate and CMP.

In contrast to these examples where the enzymes naturally have broad substrate specificities, numerous enzymes have been modified using directed evolution to broaden their specificity towards their non-natural substrates. Alternatively, the substrate preference of an enzyme has also been changed using directed evolution. Therefore, it is feasible to engineer a given enzyme for efficient function on a natural, for example, improved efficiency, or a non-natural substrate, for example, increased efficiency. For example, it has been reported that the enantioselectivity of a lipase from *Pseudomonas aeruginosa* was improved significantly (Reetz et al., *Agnew. Chem. Int. Ed Engl.* 36:2830-2832 (1997)). This enzyme hydrolyzed p-nitrophenyl 2-methyldecanoate with only 2% enantiomeric excess (ee) in favor of the (S)-acid. However, after four successive rounds of error-prone mutagenesis and screening, a variant was produced that catalyzed the requisite reaction with 81% ee (Reetz et al., *Agnew. Chem. Int. Ed Engl.* 36:2830-2832 (1997)).

Directed evolution methods have been used to modify an enzyme to function on an array of non-natural substrates. The substrate specificity of the lipase in *P. aeruginosa* was broadened by randomization of amino acid residues near the active site. This allowed for the acceptance of alpha-substituted carboxylic acid esters by this enzyme (Reetz et al., *Agnew. Chem. Int. Ed Engl.* 44:4192-4196 (2005)). In another successful modification of an enzyme, DNA shuffling was employed to create an *Escherichia coli* aminotransferase that accepted β-branched substrates, which were poorly accepted by the wild-type enzyme (Yano et al., *Proc. Nat. Acad Sci. U.S.A.* 95:5511-5515 (1998)). Specifically, at the end of four rounds of shuffling, the activity of aspartate aminotransferase for valine and 2-oxovaline increased by up to five orders of magnitude, while decreasing the activity towards the natural substrate, aspartate, by up to 30-fold. Recently, an algorithm was used to design a retro-aldolase that could be used to catalyze the carbon-carbon bond cleavage in a non-natural and non-biological substrate, 4-hydroxy-4-(6-methoxy-2-naphthyl)-2-butanone (Jiang et al., *Science* 319:1387-1391 (2008)). These algorithms used different combinations of four different catalytic motifs to design new enzyme, and 20 of the selected designs for experimental characterization had four-fold improved rates over the uncatalyzed reaction (Jiang et al., *Science* 319: 1387-1391 (2008)). Thus, not only are these engineering approaches capable of expanding the array of substrates on which an enzyme can act, but they allow the design and construction of very efficient enzymes. For example, a method of DNA shuffling (random chimeragenesis on transient templates or RACHITT) was reported to lead to an engineered monooxygenase that had an improved rate of desulfurization on complex substrates as well as 20-fold faster conversion of a non-natural substrate (Coco et al., *Nat. Biotechnol.* 19:354-359 (2001)). Similarly, the specific activity of a sluggish mutant triosephosphate isomerase enzyme was improved up to 19-fold from 1.3 fold (Hermes et al., *Proc. Nat. Acad Sci. U.S.A.* 87:696-700 1990)). This enhancement in specific activity was accomplished by using random mutagenesis over the whole length of the protein and the improvement could be traced back to mutations in six amino acid residues.

The effectiveness of protein engineering approaches to alter the substrate specificity of an enzyme for a desired substrate has also been demonstrated in several studies. Isopropylmalate dehydrogenase from *Thermus thermophilus* was modified by changing residues close to the active site so that it could now act on malate and D-lactate as substrates (Fujita et al., *Biosci. Biotechnol. Biochem.* 65:2695-2700 (2001)). In this study as well as in others, it was pointed out that one or a few residues could be modified to alter the substrate specificity. For example, the dihydroflavonol 4-reductase for which a single amino acid was changed in the presumed substrate-binding region could preferentially reduce dihydrokaempferol (Johnson et al., *Plant. J.* 25:325-333 (2001)). The substrate specificity of a very specific isocitrate dehydrogenase from *Escherichia coli* was changed form isocitrate to isopropylmalate by changing one residue in the active site (Doyle et al., *Biochemistry* 40:4234-4241 (2001)). Similarly, the cofactor specificity of a $NAD^+$-dependent 1,5-hydroxyprostaglandin dehydrogenase was altered to $NADP^+$ by changing a few residues near the N-terminal end (Cho et al., *Arch. Biochem. Biophys.* 419:139-146 (2003)). Sequence analysis and molecular modeling analysis were used to identify the key residues for modification, which were further studied by site-directed mutagenesis.

Numerous examples exist spanning diverse classes of enzymes where the function of enzyme was changed to favor one non-natural substrate over the natural substrate of the enzyme. A fucosidase was evolved from a galactosidase in *E. coli* by DNA shuffling and screening (Zhang et al., *Proc. Natl Acad Sci. U.S.A.* 94:4504-4509 (1997)). Similarly, aspartate aminotransferase from *E. coli* was converted into a tyrosine aminotransferase using homology modeling and site-directed mutagenesis (Onuffer and Kirsch, *Protein Sci.*, 4:1750-1757 (1995)). Site-directed mutagenesis of two residues in the active site of benzoylformate decarboxylase from *P. putida* reportedly altered the affinity ($K_m$) towards natural and non-natural substrates (Siegert et al., *Protein Eng Des Sel* 18:345-357 (2005)). Cytochrome c peroxidase (CCP) from *Saccharomyces cerevisiae* was subjected to directed molecular evolution to generate mutants with increased activity against the classical peroxidase substrate guaiacol, thus changing the substrate specificity of CCP from the protein cytochrome c to a small organic molecule. After three rounds of DNA shuffling and screening mutants were isolated which possessed a 300-fold increased activity against guaiacol and up to 1000-fold increased specificity for this substrate relative to that for the natural substrate (Iffland et al., *Biochemistry* 39:10790-10798 (2000)).

In some cases, enzymes with different substrate preferences than either of the parent enzymes have been obtained. For example, biphenyl-dioxygenase-mediated degradation of polychlorinated biphenyls was improved by shuffling genes from two bacteria, *Pseudomonas pseudoalcaligens* and *Burkholderia cepacia* (Kumamaru et al., *Nat. Biotechnol.* 16:663-666 (1998)). The resulting chimeric biphenyl oxygenases showed different substrate preferences than both the parental enzymes and enhanced the degradation activity towards related biphenyl compounds and single aromatic ring hydrocarbons such as toluene and benzene which were originally poor substrates for the enzyme.

In addition to changing enzyme specificity, it is also possible to enhance the activities on substrates for which the enzymes naturally have low activities. One study demonstrated that amino acid racemase from *P. putida* that had broad substrate specificity (on lysine, arginine, alanine, serine, methionine, cysteine, leucine and histidine among others) but low activity towards tryptophan could be improved significantly by random mutagenesis (Kino et al., *Appl. Microbiol. Biotechnol.* 73:1299-1305 (2007)). Similarly, the active site of the bovine BCKAD was engineered to favor alternate substrate acetyl-CoA (Meng and Chuang, *Biochemistry* 33:12879-12885 (1994)). An interesting aspect of these approaches is that even if random methods have been applied to generate these mutated enzymes with efficacious activities, the exact mutations or structural changes that confer the improvement in activity can be identified. For example, in the aforementioned study, the mutations that facilitated improved activity on tryptophan was traced back to two different positions.

Directed evolution has also been used to express proteins that are difficult to express. For example, by subjecting horseradish peroxidase to random mutagenesis and gene recombination, mutants were identified that had more than 14-fold higher activity than the wild type (Lin et al., *Biotechnol. Prog.* 15:467-471 (1999)).

Another example of directed evolution shows the extensive modifications to which an enzyme can be subjected to achieve a range of desired functions. The enzyme lactate dehydrogenase from *Bacillus stearothermophilus* was subjected to site-directed mutagenesis, and three amino acid substitutions were made at sites that were believed to determine the specificity towards different hydroxyacids (Clarke et al., *Biochem. Biophys. Res. Commun.* 148:15-23 (1987)). After these mutations, the specificity for oxaloacetate over pyruvate was increased to 500 in contrast to the wild type enzyme that had a catalytic specificity for pyruvate over oxaloacetate of 1000. This enzyme was further engineered using site-directed mutagenesis to have activity towards branched-chain substituted pyruvates (Wilks et al., *Biochemistry* 29:8587-8591 (1990)). Specifically, the enzyme had a 55-fold improvement in $K_{cat}$ for alpha-ketoisocaproate. Three structural modifications were made in the same enzyme to change its substrate specificity from lactate to malate. The enzyme was highly active and specific towards malate (Wilks et al., *Science* 242:1541-1544 (1988)). The same enzyme from *B. stearothermophilus* was subsequently engineered to have high catalytic activity towards alpha-keto acids with positively charged side chains, such as those containing ammonium groups (Hogan et al., *Biochemistry* 34:4225-4230 (1995)). Mutants with acidic amino acids introduced at position 102 of the enzyme favored binding of such side chain ammonium groups. The results obtained proved that the mutants showed up to 25-fold improvements in $k_{cat}/K_m$ values for omega-amino-alpha-keto acid substrates. Interestingly, this enzyme was also structurally modified to function as a phenyllactate dehydrogenase instead of a lactate dehydrogenase (Wilks et al., *Biochemistry* 31:7802-7806 1992). Restriction sites were introduced into the gene for the enzyme which allowed a region of the gene to be excised. This region coded for a mobile surface loop of the polypeptide (residues 98-110) which normally seals the active site from bulk solvent and is a major determinant of substrate specificity. The variable length and sequence loops were inserted so that hydroxyacid dehydrogenases with altered substrate specificities were generated. With one longer loop construction, activity with pyruvate was reduced one-million-fold but activity with phenylpyruvate was largely unaltered. A switch in specificity ($k_{cat}/K_m$) of 390,000-fold was achieved. The 1700:1 selectivity of this enzyme for phenylpyruvate over pyruvate is that required in a phenyllactate dehydrogenase. The studies described above indicate that various approaches of enzyme engineering can be used to obtain enzymes for the BDO pathways as disclosed herein.

Figure 2:
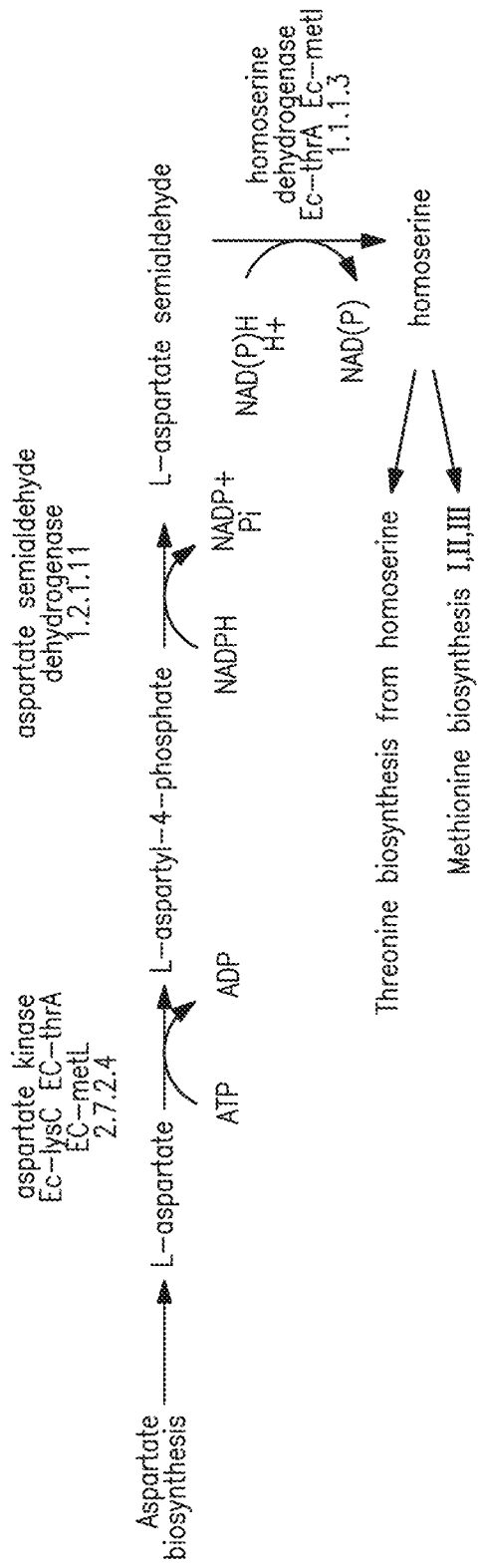
FIG. 2 is a schematic diagram showing homoserine biosynthesis in *E. coli*.

As disclosed herein, biosynthetic pathways to 1,4-butanediol from a number of central metabolic intermediates are can be utilized, including acetyl-CoA, succinyl-CoA, alpha-ketoglutarate, glutamate, 4-aminobutyrate, and homoserine. Acetyl-CoA, succinyl-CoA and alpha-ketoglutarate are common intermediates of the tricarboxylic acid (TCA) cycle, a series of reactions that is present in its entirety in nearly all living cells that utilize oxygen for cellular respiration and is present in truncated forms in a number of anaerobic organisms. Glutamate is an amino acid that is derived from alpha-ketoglutarate via glutamate dehydrogenase or any of a number of transamination reactions (see FIG. 8B). 4-aminobutyrate can be formed by the decarboxylation of glutamate (see FIG. 8B) or from acetoacetyl-CoA via the pathway disclosed in FIG. 9C. Acetoacetyl-CoA is derived from the condensation of two acetyl-CoA molecules by way of the enzyme, acetyl-coenzyme A acetyltransferase, or equivalently, acetoacetyl-coenzyme A thiolase. Homoserine is an intermediate in threonine and methionine metabolism, formed from oxaloacetate via aspartate. The conversion of oxaloacetate to homoserine requires one NADH, two NADPH, and one ATP Pathways other than those exemplified above also can be employed to generate the biosynthesis of BDO in non-naturally occurring microbial organisms. In one embodiment, biosynthesis can be achieved using a L-homoserine to BDO pathway (see FIG. 13). This pathway has a molar yield of 0.90 mol/mol glucose, which appears restricted by the availability of reducing equivalents. A second pathway synthesizes BDO from acetoacetyl-CoA and is capable of achieving the maximum theoretical yield of 1.091 mol/mol glucose (see FIG. 9). Implementation of either pathway can be achieved by introduction of two exogenous enzymes into a host organism such as *E. coli*, and both pathways can additionally complement BDO production via succinyl-CoA. Pathway enzymes, thermodynamics, theoretical yields and overall feasibility are described further below A homoserine pathway also can be engineered to generate BDO-producing microbial organisms. Homoserine is an intermediate in threonine and methionine metabolism, formed from oxaloacetate via aspartate. The conversion of oxaloacetate to homoserine requires one NADH, two NADPH, and one ATP (FIG. 2). Once formed, homoserine feeds into biosynthetic pathways for both threonine and methionine. In most organisms, high levels of threonine or methionine feedback to repress the homoserine biosynthesis pathway (Caspi et al., *Nucleic Acids Res.* 34:D511-D516 (1990)).

The transformation of homoserine to 4-hydroxybutyrate (4-HB) can be accomplished in two enzymatic steps as described herein. The first step of this pathway is deamination of homoserine by a putative ammonia lyase. In step 2, the product alkene, 4-hydroxybut-2-enoate is reduced to 4-HB by a putative reductase at the cost of one NADH. 4-HB can then be converted to BDO.

Enzymes available for catalyzing the above transformations are disclosed herein. For example, the ammonia lyase in step 1 of the pathway closely resembles the chemistry of aspartate ammonia-lyase (aspartase). Aspartase is a widespread enzyme in microorganisms, and has been characterized extensively (Viola, R. E., *Mol. Biol.* 74:295-341 (2008)). The crystal structure of the *E. coli* aspartase has been solved (Shi et al., *Biochemistry* 36:9136-9144 (1997)), so it is therefore possible to directly engineer mutations in the enzyme's active site that would alter its substrate specificity to include homoserine. The oxidoreductase in step 2 has chemistry similar to several well-characterized enzymes including fumarate reductase in the *E. coli* TCA cycle. Since the thermodynamics of this reaction are highly favorable, an endogenous reductase with broad substrate specificity will likely be able to reduce 4-hydroxybut-2-enoate. The yield of this pathway under anaerobic conditions is 0.9 mol BDO per mol glucose.

The succinyl-CoA pathway was found to have a higher yield due to the fact that it is more energetically efficient. The conversion of one oxaloacetate molecule to BDO via the homoserine pathway will require the expenditure of 2 ATP equivalents. Because the conversion of glucose to two oxaloacetate molecules can generate a maximum of 3 ATP molecules assuming PEP carboxykinase to be reversible, the overall conversion of glucose to BDO via homoserine has a negative energetic yield. As expected, if it is assumed that energy can be generated via respiration, the maximum yield of the homoserine pathway increases to 1.05 mol/mol glucose which is 96% of the succinyl-CoA pathway yield. The succinyl-CoA pathway can channel some of the carbon flux through pyruvate dehydrogenase and the oxidative branch of the TCA cycle to generate both reducing equivalents and succinyl-CoA without an energetic expenditure. Thus, it does not encounter the same energetic difficulties as the homoserine pathway because not all of the flux is channeled through oxaloacetate to succinyl-CoA to BDO. Overall, the homoserine pathway demonstrates a high-yielding route to BDO.

An acetoacetate pathway also can be engineered to generate BDO-producing microbial organisms. Acetoacetate can be formed from acetyl-CoA by enzymes involved in fatty acid metabolism, including acetyl-CoA acetyltransferase and acetoacetyl-CoA transferase. Biosynthetic routes through acetoacetate are also particularly useful in microbial organisms that can metabolize single carbon compounds such as carbon monoxide, carbon dioxide or methanol to form acetyl-CoA.

A three step route from acetoacetyl-CoA to 4-aminobutyrate (see FIG. 9C) can be used to synthesize BDO through acetoacetyl-CoA. 4-Aminobutyrate can be converted to succinic semialdehyde as shown in FIG. 8B. Succinic semialdehyde, which is one reduction step removed from succinyl-CoA or one decarboxylation step removed from α-ketoglutarate, can be converted to BDO following three reductions steps (FIG. 1). Briefly, step 1 of this pathway involves the conversion of acetoacetyl-CoA to acetoacetate by, for example, the *E. coli* acetoacetyl-CoA transferase encoded by the atoA and atoD genes (Hanai et al., *Appl. Environ. Microbiol.* 73: 7814-7818 (2007)). Step 2 of the acetoacetyl-CoA biopathway entails conversion of acetoacetate to 3-aminobutanoate by an ω-aminotransferase. The co-amino acid:pyruvate aminotransferase (ω-APT) from *Alcaligens denitrificans* was overexpressed in *E. coli* and shown to have a high activity toward 3-aminobutanoate in vitro (Yun et al., *Appl. Environ. Microbiol.* 70:2529-2534 (2004)).

In step 2, a putative aminomutase shifts the amine group from the 3- to the 4-position of the carbon backbone. An aminomutase performing this function on 3-aminobutanoate has not been characterized, but an enzyme from *Clostridium sticklandii* has a very similar mechanism. The enzyme, D-lysine-5,6-aminomutase, is involved in lysine biosynthesis.

The synthetic route to BDO from acetoacetyl-CoA passes through 4-aminobutanoate, a metabolite in *E. coli* that is normally formed from decarboxylation of glutamate. Once formed, 4-aminobutanoate can be converted to succinic semialdehyde by 4-aminobutanoate transaminase (2.6.1.19), an enzyme which has been biochemically characterized.

One consideration for selecting candidate enzymes in this pathway is the stereoselectivity of the enzymes involved in steps 2 and 3. The ω-ABT in Alcaligens *denitrificans* is specific to the L-stereoisomer of 3-aminobutanoate, while D-lysine-5,6-aminomutase likely requires the D-stereoisomer. If enzymes with complementary stereoselectivity are not initially found or engineered, a third enzyme can be added to the pathway with racemase activity that can convert L-3-aminobutanoate to D-3-aminobutanoate. While amino acid racemases are widespread, whether these enzymes can function on co-amino acids is not known.

The maximum theoretical molar yield of this pathway under anaerobic conditions is 1.091 mol/mol glucose. In order to generate flux from acetoacetyl-CoA to BDO it was necessary to assume that acetyl-CoA:acetoacetyl-CoA transferase is reversible. The function of this enzyme in *E. coli* is to metabolize short-chain fatty acids by first converting them into thioesters.

While the operation of acetyl-CoA:acetoacetyl-CoA transferase in the acetate-consuming direction has not been demonstrated experimentally in *E. coli*, studies on similar enzymes in other organisms support the assumption that this reaction is reversible. The enzyme butyryl-CoA:acetate:CoA transferase in gut microbes *Roseburia* sp. and *F. pranitzii* operates in the acetate utilizing direction to produce butyrate (Duncan et al., *Appl. Environ. Microbiol* 68:5186-5190 (2002)). Another very similar enzyme, acetyl:succinate CoA-transferase in *Trypanosoma brucei*, also operates in the acetate utilizing direction. This reaction has a $\Delta_{rxn}G$ close to equilibrium, so high concentrations of acetate can likely drive the reaction in the direction of interest. At the maximum theoretical BDO production rate of 1.09 mol/mol glucose simulations predict that *E. coli* can generate 1.098 mol ATP per mol glucose with no fermentation byproducts. This ATP yield should be sufficient for cell growth, maintenance, and production. The acetoacetatyl-CoAbiopathway is a high-yielding route to BDO from acetyl-CoA.

Therefore, in addition to any of the various modifications exemplified previously for establishing 4-HB biosynthesis in a selected host, the BDO producing microbial organisms can include any of the previous combinations and permutations of 4-HB pathway metabolic modifications as well as any combination of expression for CoA-independent aldehyde dehydrogenase, CoA-dependent aldehyde dehydrogenase or an alcohol dehydrogenase or other enzymes disclosed herein to generate biosynthetic pathways for GBL and/or BDO. Therefore, the BDO producers of the invention can have exogenous expression of, for example, one, two, three, four, five, six, seven, eight, nine, or up to all enzymes corresponding to any of the 4-HB pathway and/or any of the BDO pathway enzymes disclosed herein.

Design and construction of the genetically modified microbial organisms is carried out using methods well known in the art to achieve sufficient amounts of expression to produce BDO. In particular, the non-naturally occurring microbial organisms of the invention can achieve biosynthesis of BDO resulting in intracellular concentrations between about 0.1-200 mM or more, such as about 0.1-25 mM or more, as discussed above. For example, the intracellular concentration of BDO is between about 3-20 mM, particularly between about 5-15 mM and more particularly between about 8-12 mM, including about 10 mM or more. Intracellular concentrations between and above each of these exemplary ranges also can be achieved from the non-naturally occurring microbial organisms of the invention. As with the 4-HB producers, the BDO producers also can be sustained, cultured or fermented under anaerobic conditions.

The invention further provides a method for the production of 4-HB. The method includes culturing a non-naturally occurring microbial organism having a 4-hydroxybutanoic acid (4-HB) biosynthetic pathway comprising at least one exogenous nucleic acid encoding 4-hydroxybutanoate dehydrogenase, CoA-independent succinic semialdehyde dehydrogenase, succinyl-CoA synthetase, CoA-dependent succinic semialdehyde dehydrogenase, glutamate: succinic semialdehyde transaminase, α-ketoglutarate decarboxylase, or glutamate decarboxylase under substantially anaerobic conditions for a sufficient period of time to produce monomeric 4-hydroxybutanoic acid (4-HB). The method can additionally include chemical conversion of 4-HB to GBL and to BDO or THF, for example.

Additionally provided is a method for the production of 4-HB. The method includes culturing a non-naturally occurring microbial organism having a 4-hydroxybutanoic acid (4-HB) biosynthetic pathway including at least one exogenous nucleic acid encoding 4-hydroxybutanoate dehydrogenase, succinyl-CoA synthetase, CoA-dependent succinic semialdehyde dehydrogenase or α-ketoglutarate decarboxylase under substantially anaerobic conditions for a sufficient period of time to produce monomeric 4-hydroxybutanoic acid (4-HB). The 4-HB product can be secreted into the culture medium.

Further provided is a method for the production of BDO. The method includes culturing a non-naturally occurring microbial biocatalyst or microbial organism, comprising a microbial organism having 4-hydroxybutanoic acid (4-HB) and 1,4-butanediol (BDO) biosynthetic pathways, the pathways including at least one exogenous nucleic acid encoding 4-hydroxybutanoate dehydrogenase, succinyl-CoA synthetase, CoA-dependent succinic semialdehyde dehydrogenase, 4-hydroxybutyrate:CoA transferase, 4-hydroxybutyrate kinase, phosphotranshydroxybutyrylase, α-ketoglutarate decarboxylase, aldehyde dehydrogenase, alcohol dehydrogenase or an aldehyde/alcohol dehydrogenase for a sufficient period of time to produce 1,4-butanediol (BDO). The BDO product can be secreted into the culture medium.

Additionally provided are methods for producing BDO by culturing a non-naturally occurring microbial organism having a BDO pathway of the invention. The BDO pathway can comprise at least one exogenous nucleic acid encoding a BDO pathway enzyme expressed in a sufficient amount to produce BDO, under conditions and for a sufficient period of time to produce BDO, the BDO pathway comprising 4-aminobutyrate CoA transferase, 4-aminobutyryl-CoA hydrolase, 4-aminobutyrate-CoA ligase, 4-aminobutyryl-CoA oxidoreductase (deaminating), 4-aminobutyryl-CoA transaminase, or 4-hydroxybutyryl-CoA dehydrogenase (see Example VII; see corresponding Example and Table 17 in WO2013/184602).

Alternatively, the BDO pathway can compare at least one exogenous nucleic acid encoding a BDO pathway enzyme expressed in a sufficient amount to produce BDO, under conditions and for a sufficient period of time to produce BDO, the BDO pathway comprising 4-aminobutyrate CoA transferase, 4-aminobutyryl-CoA hydrolase, 4-aminobutyrate-CoA ligase, 4-aminobutyryl-CoA reductase (alcohol forming), 4-aminobutyryl-CoA reductase, 4-aminobutan-1-ol dehydrogenase, 4-aminobutan-1-ol oxidoreductase (deaminating) or 4-aminobutan-1-ol transaminase (see Example VII; see corresponding Example and Table 18 in WO2013/184602).

In addition, the invention provides a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising 4-aminobutyrate kinase, 4-aminobutyraldehyde dehydrogenase (phosphorylating), 4-aminobutan-1-ol dehydrogenase, 4-aminobutan-1-ol oxidoreductase (deaminating), 4-aminobutan-1-ol transaminase, [(4-aminobutanolyl)oxy]phosphonic acid oxidoreductase (deaminating), [(4-aminobutanolyl)oxy]phosphonic acid transaminase, 4-hydroxybutyryl-phosphate dehydrogenase, or 4-hydroxybutyraldehyde dehydrogenase (phosphorylating) (see Example VII; see corresponding Example and Table 19 in WO2013/184602).

The invention further provides a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising alpha-ketoglutarate 5-kinase, 2,5-dioxopentanoic semialdehyde dehydrogenase (phosphorylating), 2,5-dioxopentanoic acid reductase, alpha-ketoglutarate CoA transferase, alpha-ketoglutaryl-CoA hydrolase, alpha-ketoglutaryl-CoA ligase, alpha-ketoglutaryl-CoA reductase, 5-hydroxy-2-oxopentanoic acid dehydrogenase, alpha-ketoglutaryl-CoA reductase (alcohol forming), 5-hydroxy-2-oxopentanoic acid decarboxylase, or 5-hydroxy-2-oxopentanoic acid dehydrogenase (decarboxylation)(see Example VIII; see corresponding Example and Table 20 in WO2013/184602).

The invention additionally provides a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising glutamate CoA transferase, glutamyl-CoA hydrolase, glutamyl-CoA ligase, glutamate 5-kinase, glutamate-5-semialdehyde dehydrogenase (phosphorylating), glutamyl-CoA reductase, glutamate-5-semialdehyde reductase, glutamyl-CoA reductase (alcohol forming), 2-amino-5-hydroxypentanoic acid oxidoreductase (deaminating), 2-amino-5-hydroxypentanoic acid transaminase, 5-hydroxy-2-oxopentanoic acid decarboxylase, 5-hydroxy-2-oxopentanoic acid dehydrogenase (decarboxylation)(see Example IX; see corresponding Example and Table 21 in WO2013/184602).

The invention additionally includes a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising 3-hydroxybutyryl-CoA dehydrogenase, 3-hydroxybutyryl-CoA dehydratase, vinylacetyl-CoA Δ-isomerase, or 4-hydroxybutyryl-CoA dehydratase (see Example X; see corresponding Example and Table 22 in WO2013/184602).

Also provided is a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising homoserine deaminase, homoserine CoA transferase, homoserine-CoA hydrolase, homoserine-CoA ligase, homoserine-CoA deaminase, 4-hydroxybut-2-enoyl-CoA transferase, 4-hydroxybut-2-enoyl-CoA hydrolase, 4-hydroxybut-2-enoyl-CoA ligase, 4-hydroxybut-2-enoate reductase, 4-hydroxybutyryl-CoA transferase, 4-hydroxybutyryl-CoA hydrolase, 4-hydroxybutyryl-CoA ligase, or 4-hydroxybut-2-enoyl-CoA reductase (see Example XI; see corresponding Example and Table 23 in WO2013/184602).

The invention additionally provides a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising succinyl-CoA reductase (alcohol forming), 4-hydroxybutyryl-CoA hydrolase, 4-hydroxybutyryl-CoA ligase, 4-hydroxybutanal dehydrogenase (phosphorylating). Such a BDO pathway can further comprise succinyl-CoA reductase, 4-hydroxybutyrate dehydrogenase, 4-hydroxybutyryl-CoA transferase, 4-hydroxybutyrate kinase, phosphotrans-4-hydroxybutyrylase, 4-hydroxybutyryl-CoA reductase, 4-hydroxybutyryl-CoA reductase (alcohol forming), or 1,4-butanediol dehydrogenase.

Also provided is a method for producing BDO, comprising culturing a non-naturally occurring microbial organism having a BDO pathway, the pathway comprising at least one exogenous nucleic acid encoding a BDO pathway enzyme expressed in a sufficient amount to produce BDO, under conditions and for a sufficient period of time to produce BDO, the BDO pathway comprising glutamate dehydrogenase, 4-aminobutyrate oxidoreductase (deaminating), 4-aminobutyrate transaminase, glutamate decarboxylase, 4-hydroxybutyryl-CoA hydrolase, 4-hydroxybutyryl-CoA ligase, 4-hydroxybutanal dehydrogenase (phosphorylating).

The invention additionally provides methods of producing a desired product using the genetically modified organisms disclosed herein that allow improved production of a desired product such as BDO by increasing the product or decreasing undesirable byproducts. Thus, the invention provides a method for producing 1,4-butanediol (BDO), comprising culturing the non-naturally occurring microbial organisms disclosed herein under conditions and for a sufficient period of time to produce BDO. In one embodiment, the invention provides a method of producing BDO using a non-naturally occurring microbial organism, comprising a microbial organism having a 1,4-butanediol (BDO) pathway comprising at least one exogenous nucleic acid encoding a BDO pathway enzyme expressed in a sufficient amount to produce BDO. In one embodiment, the microbial organism is genetically modified to express exogenous succinyl-CoA synthetase (see Example XII). For example, the succinyl-CoA synthetase can be encoded by an *Escherichia coli* sucCD genes.

In another embodiment, the microbial organism is genetically modified to express exogenous alpha-ketoglutarate decarboxylase (see Example XIII). For example, the alpha-ketoglutarate decarboxylase can be encoded by the *Mycobacterium bovis* sucA gene. In still another embodiment, the microbial organism is genetically modified to express exogenous succinate semialdehyde dehydrogenase and 4-hydroxybutyrate dehydrogenase and optionally 4-hydroxybutyryl-CoA/acetyl-CoA transferase (see Example XIII). For example, the succinate semialdehyde dehydrogenase (CoA-dependent), 4-hydroxybutyrate dehydrogenase and 4-hydroxybutyryl-CoA/acetyl-CoA transferase can be encoded by *Porphyromonas gingivalis* W83 genes. In an additional embodiment, the microbial organism is genetically modified to express exogenous butyrate kinase and phosphotransbutyrylase (see Example XIII). For example, the butyrate kinase and phosphotransbutyrylase can be encoded by *Clostridium acetobutilicum* buk1 and ptb genes.

In yet another embodiment, the microbial organism is genetically modified to express exogenous 4-hydroxybutyryl-CoA reductase (see Example XIII). For example, the 4-hydroxybutyryl-CoA reductase can be encoded by *Clostridium beijerinckii* ald gene. Additionally, in an embodiment of the invention, the microbial organism is genetically modified to express exogenous 4-hydroxybutanal reductase (see Example XIII). For example, the 4-hydroxybutanal reductase can be encoded by *Geobacillus thermoglucosidasius* adh1 gene. In another embodiment, the microbial organism is genetically modified to express exogenous pyruvate dehydrogenase subunits (see Example XIV). For example, the exogenous pyruvate dehydrogenase can be NADH insensitive. The pyruvate dehydrogenase subunit can be encoded by the *Klebsiella pneumonia* lpd4 gene. In a particular embodiment, the pyruvate dehydrogenase subunit genes of the microbial organism can be under the control of a pyruvate formate lyase promoter.

In still another embodiment, the microbial organism is genetically modified to disrupt a gene encoding an aerobic respiratory control regulatory system (see Example XV). For example, the disruption can be of the arcA gene. Such an organism can further comprise disruption of a gene encoding malate dehydrogenase. In a further embodiment, the microbial organism is genetically modified to express an exogenous NADH insensitive citrate synthase (see Example XV). For example, the NADH insensitive citrate synthase can be encoded by gltA, such as an R163L mutant of gltA. In still another embodiment, the microbial organism is genetically modified to express exogenous phosphoenolpyruvate carboxykinase (see Example XVI). For example, the phosphoenolpyruvate carboxykinase can be encoded by an *Haemophilus influenza* phosphoenolpyruvate carboxykinase gene. It is understood that strains exemplified herein for improved production of BDO can similarly be used, with appropriate modifications, to produce other desired products, for example, 4-hydroxybutyrate or other desired products disclosed herein.

The invention additionally provides a method for producing 4-hydroxybutanal by culturing a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising succinyl-CoA reductase (aldehyde forming); 4-hydroxybutyrate dehydrogenase; and 4-hydroxybutyrate reductase (see FIG. 58, steps A-C-D). The invention also provides a method for producing 4-hydroxybutanal by culturing a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising alpha-ketoglutarate decarboxylase; 4-hydroxybutyrate dehydrogenase; and 4-hydroxybutyrate reductase (FIG. 58, steps B-C-D).

The invention further provides a method for producing 4-hydroxybutanal by culturing a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising succinate reductase; 4-hydroxybutyrate dehydrogenase, and 4-hydroxybutyrate reductase (see FIG. 62, steps F-C-D). In yet another embodiment, the invention provides a method for producing 4-hydroxybutanal by culturing a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising alpha-ketoglutarate decarboxylase, or glutamate dehydrogenase or glutamate transaminase and glutamate decarboxylase and 4-aminobutyrate dehydrogenase or 4-aminobutyrate transaminase; 4-hydroxybutyrate dehydrogenase; and 4-hydroxybutyrate reductase (see FIG. 62, steps B or ((J or K)-L-(M or N))-C-D).

The invention also provides a method for producing 4-hydroxybutanal by culturing a non-naturally occurring microbial organism, comprising a 4-hydroxybutanal pathway comprising at least one exogenous nucleic acid encoding a 4-hydroxybutanal pathway enzyme expressed in a sufficient amount to produce 4-hydroxybutanal, the 4-hydroxybutanal pathway comprising alpha-ketoglutarate reductase; 5-hydroxy-2-oxopentanoate dehydrogenase; and 5-hydroxy-2-oxopentanoate decarboxylase (see FIG. 62, steps X-Y-Z). The invention further provides a method for producing 4-hydroxybutyryl-CoA by culturing a non-naturally occurring microbial organism, comprising a 4-hydroxybutyryl-CoA pathway comprising at least one exogenous nucleic acid encoding a 4-hydroxybutyryl-CoA pathway enzyme expressed in a sufficient amount to produce 4-hydroxybutyryl-CoA, the 4-hydroxybutyryl-CoA pathway comprising alpha-ketoglutarate reductase; 5-hydroxy-2-oxopentanoate dehydrogenase; and 5-hydroxy-2-oxopentanoate dehydrogenase (decarboxylation) (see FIG. 62, steps X-Y-AA).

The invention additionally provides a method for producing putrescine by culturing a non-naturally occurring microbial organism, comprising a putrescine pathway comprising at least one exogenous nucleic acid encoding a putrescine pathway enzyme expressed in a sufficient amount to produce putrescine, the putrescine pathway comprising succinate reductase; 4-aminobutyrate dehydrogenase or 4-aminobutyrate transaminase; 4-aminobutyrate reductase; and putrescine dehydrogenase or putrescine transaminase (see FIG. 63, steps F-M/N-C-D/E). In still another embodiment, the invention provides a method for producing putrescine by culturing a non-naturally occurring microbial organism, comprising a putrescine pathway comprising at least one exogenous nucleic acid encoding a putrescine pathway enzyme expressed in a sufficient amount to produce putrescine, the putrescine pathway comprising alpha-ketoglutarate decarboxylase; 4-aminobutyrate dehydrogenase or 4-aminobutyrate transaminase; 4-aminobutyrate reductase; and putrescine dehydrogenase or putrescine transaminase (see FIG. 63, steps B-M/N-C-D/E). The invention additionally provides a method for producing putrescine by culturing a non-naturally occurring microbial organism, comprising a putrescine pathway comprising at least one exogenous nucleic acid encoding a putrescine pathway enzyme expressed in a sufficient amount to produce putrescine, the putrescine pathway comprising glutamate dehydrogenase or glutamate transaminase; glutamate decarboxylase; 4-aminobutyrate reductase; and putrescine dehydrogenase or putrescine transaminase (see FIG. 63, steps J/K-L-C-D/E).

The invention provides in another embodiment a method for producing putrescine by culturing a non-naturally occurring microbial organism, comprising a putrescine pathway comprising at least one exogenous nucleic acid encoding a putrescine pathway enzyme expressed in a sufficient amount to produce putrescine, the putrescine pathway comprising alpha-ketoglutarate reductase; 5-amino-2-oxopentanoate dehydrogenase or 5-amino-2-oxopentanoate transaminase; 5-amino-2-oxopentanoate decarboxylase; and putrescine dehydrogenase or putrescine transaminase (see FIG. 63, steps O-P/Q-R-D/E). Also provided is a method for producing putrescine by culturing a non-naturally occurring microbial organism, comprising a putrescine pathway comprising at least one exogenous nucleic acid encoding a putrescine pathway enzyme expressed in a sufficient amount to produce putrescine, the putrescine pathway comprising alpha-ketoglutarate reductase; 5-amino-2-oxopentanoate dehydrogenase or 5-amino-2-oxopentanoate transaminase; ornithine dehydrogenase or ornithine transaminase; and ornithine decarboxylase (see FIG. 63, steps O-P/Q-S/T-U). It is understood that a microbial organism comprising any of the pathways disclosed herein can be used to produce a desired product or intermediate, including 4-HB, 4-HBal, BDO or putrescine.

It is understood that, in methods of the invention, any of the one or more exogenous nucleic acids can be introduced into a microbial organism to produce a non-naturally occurring microbial organism of the invention. The nucleic acids can be introduced so as to confer, for example, a 4-HB, BDO, THF or GBL biosynthetic pathway onto the microbial organism. Alternatively, encoding nucleic acids can be introduced to produce an intermediate microbial organism having the biosynthetic capability to catalyze some of the required reactions to confer 4-HB, BDO, THF or GBL biosynthetic capability. For example, a non-naturally occurring microbial organism having a 4-HB biosynthetic pathway can comprise at least two exogenous nucleic acids encoding desired enzymes, such as the combination of 4-hydroxybutanoate dehydrogenase and α-ketoglutarate decarboxylase; 4-hydroxybutanoate dehydrogenase and CoA-independent succinic semialdehyde dehydrogenase; 4-hydroxybutanoate dehydrogenase and CoA-dependent succinic semialdehyde dehydrogenase; CoA-dependent succinic semialdehyde dehydrogenase and succinyl-CoA synthetase; succinyl-CoA synthetase and glutamate decarboxylase, and the like. Thus, it is understood that any combination of two or more enzymes of a biosynthetic pathway can be included in a non-naturally occurring microbial organism of the invention. Similarly, it is understood that any combination of three or more enzymes of a biosynthetic pathway can be included in a non-naturally occurring microbial organism of the invention, for example, 4-hydroxybutanoate dehydrogenase, α-ketoglutarate decarboxylase and CoA-dependent succinic semialdehyde dehydrogenase; CoA-independent succinic semialdehyde dehydrogenase and succinyl-CoA synthetase; 4-hydroxybutanoate dehydrogenase, CoA-dependent succinic semialdehyde dehydrogenase and glutamate:succinic semialdehyde transaminase, and so forth, as desired, so long as the combination of enzymes of the desired biosynthetic pathway results in production of the corresponding desired product.

Similarly, for example, with respect to any one or more exogenous nucleic acids introduced to confer BDO production, a non-naturally occurring microbial organism having a BDO biosynthetic pathway can comprise at least two exogenous nucleic acids encoding desired enzymes, such as the combination of 4-hydroxybutanoate dehydrogenase and α-ketoglutarate decarboxylase; 4-hydroxybutanoate dehydrogenase and 4-hydroxybutyryl CoA:acetyl-CoA transferase; 4-hydroxybutanoate dehydrogenase and butyrate kinase; 4-hydroxybutanoate dehydrogenase and phosphotransbutyrylase; 4-hydroxybutyryl CoA:acetyl-CoA transferase and aldehyde dehydrogenase; 4-hydroxybutyryl CoA: acetyl-CoA transferase and alcohol dehydrogenase; 4-hydroxybutyryl CoA:acetyl-CoA transferase and an aldehyde/alcohol dehydrogenase, 4-aminobutyrate-CoA transferase and 4-aminobutyryl-CoA transaminase; 4-aminobutyrate kinase and 4-aminobutan-1-ol oxidoreductase (deaminating), and the like. Thus, it is understood that any combination of two or more enzymes of a biosynthetic pathway can be included in a non-naturally occurring microbial organism of the invention. Similarly, it is understood that any combination of three or more enzymes of a biosynthetic pathway can be included in a non-naturally occurring microbial organism of the invention, for example, 4-hydroxybutanoate dehydrogenase, α-ketoglutarate decarboxylase and 4-hydroxybutyryl CoA:acetyl-CoA transferase; 4-hydroxybutanoate dehydrogenase, butyrate kinase and phosphotransbutyrylase; 4-hydroxybutanoate dehydrogenase, 4-hydroxybutyryl CoA:acetyl-CoA transferase and aldehyde dehydrogenase; 4-hydroxybutyryl CoA:acetyl-CoA transferase, aldehyde dehydrogenase and alcohol dehydrogenase; butyrate kinase, phosphotransbutyrylase and an aldehyde/alcohol dehydrogenase; 4-aminobutyryl-CoA hydrolase, 4-aminobutyryl-CoA reductase and 4-amino butan-1-ol transaminase; 3-hydroxybutyryl-CoA dehydrogenase, 3-hydroxybutyryl-CoA dehydratase and 4-hydroxybutyryl-CoA dehydratase, and the like. Similarly, any combination of four, five or more enzymes of a biosynthetic pathway as disclosed herein can be included in a non-naturally occurring microbial organism of the invention, as desired, so long as the combination of enzymes of the desired biosynthetic pathway results in production of the corresponding desired product.

Any of the non-naturally occurring microbial organisms described herein can be cultured to produce and/or secrete the biosynthetic products of the invention. For example, the 4-HB producers can be cultured for the biosynthetic production of 4-HB. The 4-HB can be isolated or be treated as described below to generate GBL, THF and/or BDO. Similarly, the BDO producers can be cultured for the biosynthetic production of BDO. The BDO can be isolated or subjected to further treatments for the chemical synthesis of BDO family compounds, as disclosed herein. Thus, the invention provides a method of producing a desired product such as 4-HB, 4-HBal, 4-HBCoA, BDO or putrescine, for example, 4-HB or BDO using a microbial organism of the invention. Optionally, a purification or isolation step can be applied, for example, distillation, to purify the product such as 4-HB, 4-HBal, 4-HBCoA, BDO or putrescine, for example, 4-hydroxybutyrate or 1,4-butanediol. Thus, the invention also provides a method for producing isolated or purified product such as 4-HB, 4-HBal, 4-HBCoA, BDO or putrescine, for example, 4-hydroxybutyrate or 1,4-butanediol, by culturing the non-naturally occurring microbial organism of the invention under conditions and for a sufficient period of time to produce the product such as 4-HB, 4-HBal, 4-HBCoA, BDO or putrescine, for example, 4-hydroxybutyrate or 1,4-butanediol, and isolating or purifying the product. The isolating or purifying can comprise a step such as distillation.

The growth medium can include, for example, any carbohydrate source which can supply a source of carbon to the non-naturally occurring microorganism. Such sources include, for example, sugars such as glucose, sucrose, xylose, arabinose, galactose, mannose, fructose and starch; or glycerol, and it is understood that a carbon source can be used alone as the sole source of carbon or in combination with other carbon sources described herein or known in the art. Other sources of carbohydrate include, for example, renewable feedstocks and biomass. Exemplary types of biomasses that can be used as feedstocks in the methods of the invention include cellulosic biomass, hemicellulosic biomass and lignin feedstocks or portions of feedstocks. Such biomass feedstocks contain, for example, carbohydrate substrates useful as carbon sources such as glucose, sucrose, xylose, arabinose, galactose, mannose, fructose and starch. Given the teachings and guidance provided herein, those skilled in the art will understand that renewable feedstocks and biomass other than those exemplified above also can be used for culturing the microbial organisms of the invention for the production of 4-HB, 4-HBal, 4-HBCoA, BDO or putrescine and other compounds of the invention.

Accordingly, given the teachings and guidance provided herein, those skilled in the art will understand that a non-naturally occurring microbial organism can be produced that secretes the biosynthesized compounds of the invention when grown on a carbon source such as a carbohydrate. Such compounds include, for example, 4-HB, 4-HBal, 4-HBCoA, BDO or putrescine and any of the intermediates metabolites in the 4-HB, 4-HBal, 4-HBCoA, BDO or putrescine pathways and/or the combined 4-HB, 4-HBal, 4-HBCoA, BDO or putrescine pathways. All that is required is to engineer in one or more of the enzyme activities shown in FIG. 1 to achieve biosynthesis of the desired compound or intermediate including, for example, inclusion of some or all of the 4-HB, 4-HBal, 4-HBCoA, BDO or putrescine biosynthetic pathways. Accordingly, the invention provides a non-naturally occurring microbial organism that secretes 4-HB when grown on a carbohydrate, secretes BDO when grown on a carbohydrate and/or secretes any of the intermediate metabolites shown in FIGS. 1, 8-13, 58, 62, 63, 69 and 70 when grown on a carbohydrate. ABDO producing microbial organisms of the invention can initiate synthesis from, for example, succinate, succinyl-CoA, α-ketoglutarate, succinic semialdehyde, 4-HB, 4-hydroxybutyrylphosphate, 4-hydroxybutyryl-CoA (4-HB-CoA) and/or 4-hydroxybutyraldehyde.

In some embodiments, culture conditions include anaerobic or substantially anaerobic growth or maintenance conditions. Exemplary anaerobic conditions have been described previously and are well known in the art. Exemplary anaerobic conditions for fermentation processes are described below in the Examples. Any of these conditions can be employed with the non-naturally occurring microbial organisms as well as other anaerobic conditions well known in the art. Under such anaerobic conditions, the 4-HB, 4-HBal, 4-HBCoA, BDO or putrescine producers can synthesize monomeric 4-HB, 4-HBal, 4-HBCoA, BDO or putrescine, respectively, at intracellular concentrations of 5-10 mM or more as well as all other concentrations exemplified previously.

A number of downstream compounds also can be generated for the 4-HB, 4-HBal, 4-HBCoA, BDO or putrescine producing non-naturally occurring microbial organisms of the invention. With respect to the 4-HB producing microbial organisms of the invention, monomeric 4-HB and GBL exist in equilibrium in the culture medium. The conversion of 4-HB to GBL can be efficiently accomplished by, for example, culturing the microbial organisms in acid pH medium. A pH less than or equal to 7.5, in particular at or below pH 5.5, spontaneously converts 4-HB to GBL.

The resultant GBL can be separated from 4-HB and other components in the culture using a variety of methods well known in the art. Such separation methods include, for example, the extraction procedures exemplified in the Examples as well as methods which include continuous liquid-liquid extraction, pervaporation, membrane filtration, membrane separation, reverse osmosis, electrodialysis, distillation, crystallization, centrifugation, extractive filtration, ion exchange chromatography, size exclusion chromatography, adsorption chromatography, and ultrafiltration. All of the above methods are well known in the art. Separated GBL can be further purified by, for example, distillation.

Another down stream compound that can be produced from the 4-HB producing non-naturally occurring microbial organisms of the invention includes, for example, BDO. This compound can be synthesized by, for example, chemical hydrogenation of GBL. Chemical hydrogenation reactions are well known in the art. One exemplary procedure includes the chemical reduction of 4-HB and/or GBL or a mixture of these two components deriving from the culture using a heterogeneous or homogeneous hydrogenation catalyst together with hydrogen, or a hydride-based reducing agent used stoichiometrically or catalytically, to produce 1,4-butanediol.

Other procedures well known in the art are equally applicable for the above chemical reaction and include, for example, WO No. 82/03854 (Bradley, et al.), which describes the hydrogenolysis of gamma-butyrolactone in the vapor phase over a copper oxide and zinc oxide catalyst. British Pat. No. 1,230,276, which describes the hydrogenation of gamma-butyrolactone using a copper oxide-chromium oxide catalyst. The hydrogenation is carried out in the liquid phase. Batch reactions also are exemplified having high total reactor pressures. Reactant and product partial pressures in the reactors are well above the respective dew points. British Pat. No. 1,314,126, which describes the hydrogenation of gamma-butyrolactone in the liquid phase over a nickel-cobalt-thorium oxide catalyst. Batch reactions are exemplified as having high total pressures and component partial pressures well above respective component dew points. British Pat. No. 1,344,557, which describes the hydrogenation of gamma-butyrolactone in the liquid phase over a copper oxide-chromium oxide catalyst. A vapor phase or vapor-containing mixed phase is indicated as suitable in some instances. A continuous flow tubular reactor is exemplified using high total reactor pressures. British Pat. No. 1,512,751, which describes the hydrogenation of gamma-butyrolactone to 1,4-butanediol in the liquid phase over a copper oxide-chromium oxide catalyst. Batch reactions are exemplified with high total reactor pressures and, where determinable, reactant and product partial pressures well above the respective dew points. U.S. Pat. No. 4,301,077, which describes the hydrogenation to 1,4-butanediol of gamma-butyrolactone over a Ru—Ni—Co—Zn catalyst. The reaction can be conducted in the liquid or gas phase or in a mixed liquid-gas phase. Exemplified are continuous flow liquid phase reactions at high total reactor pressures and relatively low reactor productivities. U.S. Pat. No. 4,048,196, which describes the production of 1,4-butanediol by the liquid phase hydrogenation of gamma-butyrolactone over a copper oxide-zinc oxide catalyst. Further exemplified is a continuous flow tubular reactor operating at high total reactor pressures and high reactant and product partial pressures. And U.S. Pat. No. 4,652,685, which describes the hydrogenation of lactones to glycols.

A further downstream compound that can be produced form the 4-HB producing microbial organisms of the invention includes, for example, THF. This compound can be synthesized by, for example, chemical hydrogenation of GBL. One exemplary procedure well known in the art applicable for the conversion of GBL to THF includes, for example, chemical reduction of 4-HB and/or GBL or a mixture of these two components deriving from the culture using a heterogeneous or homogeneous hydrogenation catalyst together with hydrogen, or a hydride-based reducing agent used stoichiometrically or catalytically, to produce tetrahydrofuran. Other procedures well know in the art are equally applicable for the above chemical reaction and include, for example, U.S. Pat. No. 6,686,310, which describes high surface area sol-gel route prepared hydrogenation catalysts. Processes for the reduction of maleic acid to tetrahydrofuran (THF) and 1,4-butanediol (BDO) and for the reduction of gamma butyrolactone to tetrahydrofuran and 1,4-butanediol also are described.

The culture conditions can include, for example, liquid culture procedures as well as fermentation and other large scale culture procedures. As described further below in the Examples, particularly useful yields of the biosynthetic products of the invention can be obtained under anaerobic or substantially anaerobic culture conditions.

Suitable purification and/or assays to test for the production of 4-HB, 4-HBal, 4-HBCoA, BDO or putrescine can be performed using well known methods. Suitable replicates such as triplicate cultures can be grown for each engineered strain to be tested. For example, product and byproduct formation in the engineered production host can be monitored. The final product and intermediates, and other organic compounds, can be analyzed by methods such as HPLC (High Performance Liquid Chromatography), GC-MS (Gas Chromatography-Mass Spectroscopy) and LC-MS (Liquid Chromatography-Mass Spectroscopy) or other suitable analytical methods using routine procedures well known in the art. The release of product in the fermentation broth can also be tested with the culture supernatant. Byproducts and residual glucose can be quantified by HPLC using, for example, a refractive index detector for glucose and alcohols, and a UV detector for organic acids (Lin et al., *Biotechnol. Bioeng.* 90:775-779 (2005)), or other suitable assay and detection methods well known in the art. The individual enzyme or protein activities from the exogenous DNA sequences can also be assayed using methods well known in the art. In one embodiment, the invention provides a method that is an assay, wherein a first enzyme is used to generate a substrate for a second test enzyme. In particular, a carboxylic acid transferase 2 (cat2), also referred to herein as a 4-hydroxybutyrate coenzyme A transferase, is used to generate 4-hydroxybutyrl-CoA, which serves as a substrate for aldehyde dehydrogenase (see Example XXXXIII). Such an assay can be conveniently used to generate a substrate, in particular for an enzyme-coupled in vitro assay. The method includes providing a carboxylic acid transferase 2, with an appropriate substrate such as 4-hydroxybutyrate, and a test enzyme such as an aldehyde dehydrogenase. It is understood that such a method can utilize well known methods of testing for product formation (see Example XXXXIII).

The 4-HB, 4-HBal, 4-HBCoA, BDO or putrescine product can be separated from other components in the culture using a variety of methods well known in the art. Such separation methods include, for example, extraction procedures as well as methods that include continuous liquid-liquid extraction, pervaporation, membrane filtration, membrane separation, reverse osmosis, electrodialysis, distillation, crystallization, centrifugation, extractive filtration, ion exchange chromatography, size exclusion chromatography, adsorption chromatography, and ultrafiltration. All of the above methods are well known in the art.

The invention further provides a method of manufacturing 4-HB. The method includes fermenting a non-naturally occurring microbial organism having a 4-hydroxybutanoic acid (4-HB) biosynthetic pathway comprising at least one exogenous nucleic acid encoding 4-hydroxybutanoate dehydrogenase, CoA-independent succinic semialdehyde dehydrogenase, succinyl-CoA synthetase, CoA-dependent succinic semialdehyde dehydrogenase, glutamate:succinic semialdehyde transaminase, α-ketoglutarate decarboxylase, or glutamate decarboxylase under substantially anaerobic conditions for a sufficient period of time to produce monomeric 4-hydroxybutanoic acid (4-HB), the process comprising fed-batch fermentation and batch separation; fed-batch fermentation and continuous separation, or continuous fermentation and continuous separation.

The culture and chemical hydrogenations described above also can be scaled up and grown continuously for manufacturing of 4-HB, 4-HBal, 4-HBCoA, GBL, BDO and/or THF or putrescine. Exemplary growth procedures include, for example, fed-batch fermentation and batch separation; fed-batch fermentation and continuous separation, or continuous fermentation and continuous separation. All of these processes are well known in the art. Employing the 4-HB producers allows for simultaneous 4-HB biosynthesis and chemical conversion to GBL, BDO and/or THF by employing the above hydrogenation procedures simultaneous with continuous cultures methods such as fermentation. Other hydrogenation procedures also are well known in the art and can be equally applied to the methods of the invention.

Fermentation procedures are particularly useful for the biosynthetic production of commercial quantities of 4-HB, 4-HBal, 4-HBCoA, BDO or putrescine. Generally, and as with non-continuous culture procedures, the continuous and/or near-continuous production of 4-HB, 4-HBal, 4-HB-CoA, BDO or putrescine will include culturing a non-naturally occurring 4-HB, 4-HBal, 4-HBCoA, BDO or putrescine producing organism of the invention in sufficient nutrients and medium to sustain and/or nearly sustain growth in an exponential phase. Continuous culture under such conditions can be include, for example, growth or culturing 1 day, 2, 3, 4, 5, 6 or 7 days or more. Additionally, continuous culture can include longer time periods 1 week, 2, 3, 4 or 5 or more weeks and up to several months. Alternatively, organisms of the invention can be cultured for hours, if suitable for a particular application. It is to be understood that the continuous and/or near-continuous culture conditions also can include all time intervals in between these exemplary periods. It is further understood that the time of culturing the microbial organism of the invention is for a sufficient period of time to produce a sufficient amount of product for a desired purpose.

Fermentation procedures are well known in the art. Briefly, fermentation for the biosynthetic production of 4-HB, 4-HBal, 4-HBCoA, BDO or putrescine or other 4-HB, 4-HBal, 4-HBCoA, BDO or putrescine derived products, including intermediates, of the invention can be utilized in, for example, fed-batch fermentation and batch separation; fed-batch fermentation and continuous separation, or continuous fermentation and continuous separation. Examples of batch and continuous fermentation procedures well known in the art are exemplified further below in the Examples.

In addition to the above fermentation procedures using the 4-HB, 4-HBal, 4-HBCoA, BDO or putrescine producers of the invention for continuous production of substantial quantities of 4-HB, 4-HBal, 4-HBCoA, BDO or putrescine, including monomeric 4-HB, respectively, the 4-HB producers also can be, for example, simultaneously subjected to chemical synthesis procedures to convert the product to other compounds or the product as described previously for the chemical conversion of monomeric 4-HB to, for example, GBL, BDO and/or THF. The BDO producers can similarly be, for example, simultaneously subjected to chemical synthesis procedures as described previously for the chemical conversion of BDO to, for example, THF, GBL, pyrrolidones and/or other BDO family compounds. In addition, the products of the 4-HB, 4-HBal, 4-HBCoA, BDO or putrescine producers can be separated from the fermentation culture and sequentially subjected to chemical or enzymatic conversion to convert the product to other compounds, if desired, as disclosed herein.

Briefly, hydrogenation of GBL in the fermentation broth can be performed as described by Frost et al., *Biotechnology Progress* 18: 201-211 (2002). Another procedure for hydrogenation during fermentation include, for example, the methods described in, for example, U.S. Pat. No. 5,478,952. This method is further exemplified in the Examples below.

Therefore, the invention additionally provides a method of manufacturing γ-butyrolactone (GBL), tetrahydrofuran (THF) or 1,4-butanediol (BDO). The method includes fermenting a non-naturally occurring microbial organism having 4-hydroxybutanoic acid (4-HB) and/or 1,4-butanediol (BDO) biosynthetic pathways, the pathways comprise at least one exogenous nucleic acid encoding 4-hydroxybutanoate dehydrogenase, CoA-independent succinic semialdehyde dehydrogenase, succinyl-CoA synthetase, CoA-dependent succinic semialdehyde dehydrogenase, 4-hydroxybutyrate:CoA transferase, glutamate:succinic semialdehyde transaminase, α-ketoglutarate decarboxylase, glutamate decarboxylase, 4-hydroxybutanoate kinase, phosphotransbutyrylase, CoA-independent 1,4-butanediol semialdehyde dehydrogenase, CoA-dependent 1,4-butanediol semialdehyde dehydrogenase, CoA-independent 1,4-butanediol alcohol dehydrogenase or CoA-dependent 1,4-butanediol alcohol dehydrogenase, under substantially anaerobic conditions for a sufficient period of time to produce 1,4-butanediol (BDO), GBL or THF, the fermenting comprising fed-batch fermentation and batch separation; fed-batch fermentation and continuous separation, or continuous fermentation and continuous separation.

In addition to the biosynthesis of 4-HB, 4-HBal, 4-HBCoA, BDO or putrescine and other products of the invention as described herein, the non-naturally occurring microbial organisms and methods of the invention also can be utilized in various combinations with each other and/or with other microbial organisms and methods well known in the art to achieve product biosynthesis by other routes. For example, one alternative to produce BDO other than use of the 4-HB producers and chemical steps or other than use of the BDO producer directly is through addition of another microbial organism capable of converting 4-HB or a 4-HB product exemplified herein to BDO.

One such procedure includes, for example, the fermentation of a 4-HB producing microbial organism of the invention to produce 4-HB, as described above and below. The 4-HB can then be used as a substrate for a second microbial organism that converts 4-HB to, for example, BDO, GBL and/or THF. The 4-HB can be added directly to another culture of the second organism or the original culture of 4-HB producers can be depleted of these microbial organisms by, for example, cell separation, and then subsequent addition of the second organism to the fermentation broth can utilized to produce the final product without intermediate purification steps. One exemplary second organism having the capacity to biochemically utilize 4-HB as a substrate for conversion to BDO, for example, is Clostridium acetobutylicum (see, for example, Jewell et al., Current Microbiology, 13:215-19 (1986)).

Thus, such a procedure includes, for example, the fermentation of a microbial organism that produces a 4-HB, 4-HBal, 4-HBCoA, BDO or putrescine pathway intermediate. The 4-HB, 4-HBal, 4-HBCoA, BDO or putrescine pathway intermediate can then be used as a substrate for a second microbial organism that converts the 4-HB, 4-HBal, 4-HBCoA, BDO or putrescine pathway intermediate to 4-HB, 4-HBal, 4-HBCoA, BDO or putrescine. The 4-HB, 4-HBal, 4-HBCoA, BDO or putrescine pathway intermediate can be added directly to another culture of the second organism or the original culture of the 4-HB, 4-HBal, 4-HBCoA BDO or putrescine pathway intermediate producers can be depleted of these microbial organisms by, for example, cell separation, and then subsequent addition of the second organism to the fermentation broth can be utilized to produce the final product without intermediate purification steps.

In other embodiments, the non-naturally occurring microbial organisms and methods of the invention can be assembled in a wide variety of subpathways to achieve biosynthesis of, for example, 4-HB and/or BDO and/or other pathway intermediates as described. In these embodiments, biosynthetic pathways for a desired product of the invention can be segregated into different microbial organisms, and the different microbial organisms can be co-cultured to produce the final product. In such a biosynthetic scheme, the product of one microbial organism is the substrate for a second microbial organism until the final product is synthesized. For example, the biosynthesis of BDO can be accomplished as described herein by constructing a microbial organism that contains biosynthetic pathways for conversion of one pathway intermediate to another pathway intermediate or the product, for example, a substrate such as endogenous succinate through 4-HB to the final product BDO. Alternatively, BDO also can be biosynthetically produced from microbial organisms through co-culture or co-fermentation using two organisms in the same vessel. A first microbial organism being a 4-HB producer with genes to produce 4-HB from succinic acid, and a second microbial organism being a BDO producer with genes to convert 4-HB to BDO. For example, the biosynthesis of 4-HB, 4-HBal, 4-HBCoA, BDO or putrescine can be accomplished by constructing a microbial organism that contains biosynthetic pathways for conversion of one pathway intermediate to another pathway intermediate or the product. Alternatively, 4-HB, 4-HBal, 4-HBCoA, BDO or putrescine also can be biosynthetically produced from microbial organisms through co-culture or co-fermentation using two organisms in the same vessel, where the first microbial organism produces a 4-HB, 4-HBal, 4-HBCoA, BDO or putrescine intermediate and the second microbial organism converts the intermediate to 4-HB, 4-HBal, 4-HBCoA, BDO or putrescine.

Given the teachings and guidance provided herein, those skilled in the art will understand that a wide variety of combinations and permutations exist for the non-naturally occurring microbial organisms and methods of the invention together with other microbial organisms, with the co-culture of other non-naturally occurring microbial organisms having subpathways and with combinations of other chemical and/or biochemical procedures well known in the art to produce 4-HB, 4-HBal, BDO, GBL, THF and putrescine products of the invention.

Similarly, it is understood by those skilled in the art that a host organism can be selected based on desired characteristics for introduction of one or more gene disruptions to increase production of 4-HB, 4-HBal, 4-HBCoA, BDO or putrescine. Thus, it is understood that, if a genetic modification is to be introduced into a host organism to disrupt a gene, any homologs, orthologs or paralogs that catalyze similar, yet non-identical metabolic reactions can similarly be disrupted to ensure that a desired metabolic reaction is sufficiently disrupted. Because certain differences exist among metabolic networks between different organisms, those skilled in the art will understand that the actual genes disrupted in a given organism may differ between organisms. However, given the teachings and guidance provided herein, those skilled in the art also will understand that the methods of the invention can be applied to any suitable host microorganism to identify the cognate metabolic alterations needed to construct an organism in a species of interest that will increase 4-HB, 4-HBal, 4-HBCoA, BDO or putrescine biosynthesis. In a particular embodiment, the increased production couples biosynthesis of 4-HB, 4-HBal, 4-HBCoA, BDO or putrescine to growth of the organism, and can obligatorily couple production of 4-HB, 4-HBal, 4-HBCoA, BDO or putrescine to growth of the organism if desired and as disclosed herein.

It is understood that, in methods of the invention, any of the one or more exogenous nucleic acids can be introduced into a microbial organism to produce a non-naturally occurring microbial organism of the invention. The nucleic acids can be introduced so as to confer, for example, a 4-HB, 4-HBal, 4-HBCoA, BDO or putrescine biosynthetic pathway onto the microbial organism. Alternatively, encoding nucleic acids can be introduced to produce an intermediate microbial organism having the biosynthetic capability to catalyze some of the required reactions to confer 4-HB, 4-HBal, 4-HBCoA, BDO or putrescine biosynthetic capability. For example, a non-naturally occurring microbial organism having a 4-HB, 4-HBal, 4-HBCoA, BDO or putrescine biosynthetic pathway can comprise at least two exogenous nucleic acids encoding desired enzymes or proteins, such as the combination of enzymes as disclosed herein (see Examples and FIGS. 1, 8-13, 58, 62, 63, 69 and 70), and the like. Thus, it is understood that any combination of two or more enzymes or proteins of a biosynthetic pathway can be included in a non-naturally occurring microbial organism of the invention. Similarly, it is understood that any combination of three or more enzymes or proteins of a biosynthetic pathway can be included in a non-naturally occurring microbial organism of the invention, for example, and so forth, as desired and disclosed herein, so long as the combination of enzymes and/or proteins of the desired biosynthetic pathway results in production of the corresponding desired product. Similarly, any combination of four or more enzymes or proteins of a biosynthetic pathway as disclosed herein can be included in a non-naturally occurring microbial organism of the invention, as desired, so long as the combination of enzymes and/or proteins of the desired biosynthetic pathway results in production of the corresponding desired product.

To generate better producers, metabolic modeling can be utilized to optimize growth conditions. Modeling can also be used to design gene knockouts that additionally optimize utilization of the pathway (see, for example, U.S. patent publications US 2002/0012939, US 2003/0224363, US 2004/0029149, US 2004/0072723, US 2003/0059792, US 2002/0168654 and US 2004/0009466, and U.S. Pat. No. 7,127,379). Modeling analysis allows reliable predictions of the effects on cell growth of shifting the metabolism towards more efficient production of 4-HB, 4-HBal, 4-HBCoA, BDO or putrescine.

One computational method for identifying and designing metabolic alterations favoring biosynthesis of a desired product is the OptKnock computational framework (Burgard et al., *Biotechnol. Bioeng.* 84:647-657 (2003)). OptKnock is a metabolic modeling and simulation program that suggests gene deletion or disruption strategies that result in genetically stable microorganisms which overproduce the target product. Specifically, the framework examines the complete metabolic and/or biochemical network of a microorganism in order to suggest genetic manipulations that force the desired biochemical to become an obligatory byproduct of cell growth. By coupling biochemical production with cell growth through strategically placed gene deletions or other functional gene disruption, the growth selection pressures imposed on the engineered strains after long periods of time in a bioreactor lead to improvements in performance as a result of the compulsory growth-coupled biochemical production. Lastly, when gene deletions are constructed there is a negligible possibility of the designed strains reverting to their wild-type states because the genes selected by OptKnock are to be completely removed from the genome. Therefore, this computational methodology can be used to either identify alternative pathways that lead to biosynthesis of a desired product or used in connection with the non-naturally occurring microbial organisms for further optimization of biosynthesis of a desired product.

Briefly, OptKnock is a term used herein to refer to a computational method and system for modeling cellular metabolism. The OptKnock program relates to a framework of models and methods that incorporate particular constraints into flux balance analysis (FBA) models. These constraints include, for example, qualitative kinetic information, qualitative regulatory information, and/or DNA microarray experimental data. OptKnock also computes solutions to various metabolic problems by, for example, tightening the flux boundaries derived through flux balance models and subsequently probing the performance limits of metabolic networks in the presence of gene additions or deletions. OptKnock computational framework allows the construction of model formulations that allow an effective query of the performance limits of metabolic networks and provides methods for solving the resulting mixed-integer linear programming problems. The metabolic modeling and simulation methods referred to herein as OptKnock are described in, for example, U.S. publication 2002/0168654, filed Jan. 10, 2002, in International Patent No. PCT/US02/00660, filed Jan. 10, 2002, and U.S. publication 2009/0047719, filed Aug. 10, 2007.

Another computational method for identifying and designing metabolic alterations favoring biosynthetic production of a product is a metabolic modeling and simulation system termed SimPheny®. This computational method and system is described in, for example, U.S. publication 2003/0233218, filed Jun. 14, 2002, and in International Patent Application No. PCT/US03/18838, filed Jun. 13, 2003. SimPheny® is a computational system that can be used to produce a network model in silico and to simulate the flux of mass, energy or charge through the chemical reactions of a biological system to define a solution space that contains any and all possible functionalities of the chemical reactions in the system, thereby determining a range of allowed activities for the biological system. This approach is referred to as constraints-based modeling because the solution space is defined by constraints such as the known stoichiometry of the included reactions as well as reaction thermodynamic and capacity constraints associated with maximum fluxes through reactions. The space defined by these constraints can be interrogated to determine the phenotypic capabilities and behavior of the biological system or of its biochemical components.

These computational approaches are consistent with biological realities because biological systems are flexible and can reach the same result in many different ways. Biological systems are designed through evolutionary mechanisms that have been restricted by fundamental constraints that all living systems must face. Therefore, constraints-based modeling strategy embraces these general realities. Further, the ability to continuously impose further restrictions on a network model via the tightening of constraints results in a reduction in the size of the solution space, thereby enhancing the precision with which physiological performance or phenotype can be predicted.

Given the teachings and guidance provided herein, those skilled in the art will be able to apply various computational frameworks for metabolic modeling and simulation to design and implement biosynthesis of a desired compound in host microbial organisms. Such metabolic modeling and simulation methods include, for example, the computational systems exemplified above as SimPheny® and OptKnock. For illustration of the invention, some methods are described herein with reference to the OptKnock computation framework for modeling and simulation. Those skilled in the art will know how to apply the identification, design and implementation of the metabolic alterations using OptKnock to any of such other metabolic modeling and simulation computational frameworks and methods well known in the art.

The methods described above will provide one set of metabolic reactions to disrupt. Elimination of each reaction within the set or metabolic modification can result in a desired product as an obligatory product during the growth phase of the organism. Because the reactions are known, a solution to the bilevel OptKnock problem also will provide the associated gene or genes encoding one or more enzymes that catalyze each reaction within the set of reactions. Identification of a set of reactions and their corresponding genes encoding the enzymes participating in each reaction is generally an automated process, accomplished through correlation of the reactions with a reaction database having a relationship between enzymes and encoding genes.

Once identified, the set of reactions that are to be disrupted in order to achieve production of a desired product are implemented in the target cell or organism by functional disruption of at least one gene encoding each metabolic reaction within the set. One particularly useful means to achieve functional disruption of the reaction set is by deletion of each encoding gene. However, in some instances, it can be beneficial to disrupt the reaction by other genetic aberrations including for example, mutation, deletion of regulatory regions such as promoters or cis binding sites for regulatory factors, or by truncation of the coding sequence at any of a number of locations. These latter aberrations, resulting in less than total deletion of the gene set can be useful, for example, when rapid assessments of the coupling of a product are desired or when genetic reversion is less likely to occur.

To identify additional productive solutions to the above described bilevel OptKnock problem which lead to further sets of reactions to disrupt or metabolic modifications that can result in the biosynthesis, including growth-coupled biosynthesis of a desired product, an optimization method, termed integer cuts, can be implemented. This method proceeds by iteratively solving the OptKnock problem exemplified above with the incorporation of an additional constraint referred to as an integer cut at each iteration. Integer cut constraints effectively prevent the solution procedure from choosing the exact same set of reactions identified in any previous iteration that obligatorily couples product biosynthesis to growth. For example, if a previously identified growth-coupled metabolic modification specifies reactions 1, 2, and 3 for disruption, then the following constraint prevents the same reactions from being simultaneously considered in subsequent solutions. The integer cut method is well known in the art and can be found described in, for example, Burgard et al., *Biotechnol. Prog.* 17:791-797 (2001). As with all methods described herein with reference to their use in combination with the OptKnock computational framework for metabolic modeling and simulation, the integer cut method of reducing redundancy in iterative computational analysis also can be applied with other computational frameworks well known in the art including for example, SimPheny®.

The methods exemplified herein allow the construction of cells and organisms that biosynthetically produce a desired product, including the obligatory coupling of production of a target biochemical product to growth of the cell or organism engineered to harbor the identified genetic alterations. Therefore, the computational methods described herein allow the identification and implementation of metabolic modifications that are identified by an in silico method selected from OptKnock or SimPheny®. The set of metabolic modifications can include, for example, addition of one or more biosynthetic pathway enzymes and/or functional disruption of one or more metabolic reactions including for example, disruption by gene deletion.

As discussed above, the OptKnock methodology was developed on the premise that mutant microbial networks can be evolved towards their computationally predicted maximum-growth phenotypes when subjected to long periods of growth selection. In other words, the approach leverages an organism's ability to self-optimize under selective pressures. The OptKnock framework allows for the exhaustive enumeration of gene deletion combinations that force a coupling between biochemical production and cell growth based on network stoichiometry. The identification of optimal gene/reaction knockouts requires the solution of a bilevel optimization problem that chooses the set of active reactions such that an optimal growth solution for the resulting network overproduces the biochemical of interest (Burgard et al., *Biotechnol. Bioeng.* 84:647-657 (2003)).

An in silico stoichiometric model of *E. coli* metabolism can be employed to identify essential genes for metabolic pathways as exemplified previously and described in, for example, U.S. patent publications US 2002/0012939, US 2003/0224363, US 2004/0029149, US 2004/0072723, US 2003/0059792, US 2002/0168654 and US 2004/0009466, and in U.S. Pat. No. 7,127,379. As disclosed herein, the OptKnock mathematical framework can be applied to pinpoint gene deletions leading to the growth-coupled production of a desired product. Further, the solution of the bilevel OptKnock problem provides only one set of deletions. To enumerate all meaningful solutions, that is, all sets of knockouts leading to growth-coupled production formation, an optimization technique, termed integer cuts, can be implemented. This entails iteratively solving the OptKnock problem with the incorporation of an additional constraint referred to as an integer cut at each iteration, as discussed above.

The methods exemplified above and further illustrated in the Examples below allow the construction of cells and organisms that biosynthetically produce, including obligatory couple production of a target biochemical product to growth of the cell or organism engineered to harbor the identified genetic alterations. In this regard, metabolic alterations have been identified that result in the biosynthesis of 4-HB and 1,4-butanediol. Microorganism strains constructed with the identified metabolic alterations produce elevated levels of 4-HB, 4-HBal, 4-HBCoA, BDO or putrescine compared to unmodified microbial organisms. These strains can be beneficially used for the commercial production of 4-HB, BDO, THF, GBL, 4-HBal, 4-HBCoA or putrescine, for example, in continuous fermentation process without being subjected to the negative selective pressures.

Therefore, the computational methods described herein allow the identification and implementation of metabolic modifications that are identified by an in silico method selected from OptKnock or SimPheny®. The set of metabolic modifications can include, for example, addition of one or more biosynthetic pathway enzymes and/or functional disruption of one or more metabolic reactions including, for example, disruption by gene deletion.

Any of the non-naturally occurring microbial organisms described herein can be cultured to produce and/or secrete the biosynthetic products of the invention. For example, the 4-HB, 4-HBal, 4-HBCoA, BDO or putrescine producers can be cultured for the biosynthetic production of 4-HB, 4-HBal, 4-HBCoA, BDO or putrescine. Accordingly, in some embodiments, the invention provides culture medium having 4-HB, 4-HBal, 4-HBCoA, BDO or putrescine or a 4-HB, 4-HBal, 4-HBCoA, BDO or putrescine pathway intermediate described herein. In some aspects, the culture medium can also be separated from the non-naturally occurring microbial organisms of the invention that produced the 4-HB, 4-HBal, 4-HBCoA, BDO or putrescine or 4-HB, 4-HBal, 4-HBCoA, BDO or putrescine pathway intermediate. Methods for separating a microbial organism from culture medium are well known in the art. Exemplary methods include filtration, flocculation, precipitation, centrifugation, sedimentation, and the like.

For the production of 4-HB, 4-HBal, 4-HBCoA, BDO or putrescine, the recombinant strains are cultured in a medium with carbon source and other essential nutrients. It is sometimes desirable and can be highly desirable to maintain anaerobic conditions in the fermenter to reduce the cost of the overall process. Such conditions can be obtained, for example, by first sparging the medium with nitrogen and then sealing the flasks with a septum and crimp-cap. For strains where growth is not observed anaerobically, microaerobic or substantially anaerobic conditions can be applied by perforating the septum with a small hole for limited aeration. Exemplary anaerobic conditions have been described previously and are well-known in the art. Exemplary aerobic and anaerobic conditions are described, for example, in U.S. publication 2009/0047719, filed Aug. 10, 2007. Fermentations can be performed in a batch, fed-batch or continuous manner, as disclosed herein. Fermentations can also be conducted in two phases, if desired. The first phase can be aerobic to allow for high growth and therefore high productivity, followed by an anaerobic phase of high 4-HB, 4-HBal, 4-HBCoA, BDO or putrescine yields.

If desired, the pH of the medium can be maintained at a desired pH, in particular neutral pH, such as a pH of around 7 by addition of a base, such as NaOH or other bases, or acid, as needed to maintain the culture medium at a desirable pH. The growth rate can be determined by measuring optical density using a spectrophotometer (600 nm), and the glucose uptake rate by monitoring carbon source depletion over time.

In addition to renewable feedstocks such as those exemplified above, the 4-HB, 4-HBal, 4-HBCoA, BDO or putrescine producing microbial organisms of the invention also can be modified for growth on syngas as its source of carbon. In this specific embodiment, one or more proteins or enzymes are expressed in the 4-HB, 4-HBal, 4-HBCoA, BDO or putrescine producing organisms to provide a metabolic pathway for utilization of syngas or other gaseous carbon source.

Synthesis gas, also known as syngas or producer gas, is the major product of gasification of coal and of carbonaceous materials such as biomass materials, including agricultural crops and residues. Syngas is a mixture primarily of $H_2$ and CO and can be obtained from the gasification of any organic feedstock, including but not limited to coal, coal oil, natural gas, biomass, and waste organic matter. Gasification is generally carried out under a high fuel to oxygen ratio. Although largely $H_2$ and CO, syngas can also include $CO_2$ and other gases in smaller quantities. Thus, synthesis gas provides a cost effective source of gaseous carbon such as CO and, additionally, $CO_2$.

The Wood-Ljungdahl pathway catalyzes the conversion of CO and $H_2$ to acetyl-CoA and other products such as acetate. Organisms capable of utilizing CO and syngas also generally have the capability of utilizing $CO_2$ and $CO_2/H_2$ mixtures through the same basic set of enzymes and transformations encompassed by the Wood-Ljungdahl pathway. $H_2$-dependent conversion of $CO_2$ to acetate by microorganisms was recognized long before it was revealed that CO also could be used by the same organisms and that the same pathways were involved. Many acetogens have been shown to grow in the presence of $CO_2$ and produce compounds such as acetate as long as hydrogen is present to supply the necessary reducing equivalents (see for example, Drake, *Acetogenesis*, pp. 3-60 Chapman and Hall, New York, (1994)). This can be summarized by the following equation:

$$2CO_2 + 4H_2 + nADP + nPi \rightarrow CH_3COOH + 2H_2O + nATP$$

Hence, non-naturally occurring microorganisms possessing the Wood-Ljungdahl pathway can utilize $CO_2$ and $H_2$ mixtures as well for the production of acetyl-CoA and other desired products.

The Wood-Ljungdahl pathway is well known in the art and consists of 12 reactions which can be separated into two branches: (1) methyl branch and (2) carbonyl branch. The methyl branch converts syngas to methyl-tetrahydrofolate (methyl-THF) whereas the carbonyl branch converts methyl-THF to acetyl-CoA. The reactions in the methyl branch are catalyzed in order by the following enzymes or proteins: ferredoxin oxidoreductase, formate dehydrogenase, formyltetrahydrofolate synthetase, methenyltetrahydrofolate cyclodehydratase, methylenetetrahydrofolate dehydrogenase and methylenetetrahydrofolate reductase. The reactions in the carbonyl branch are catalyzed in order by the following enzymes or proteins: methyltetrahydrofolate:corrinoid protein methyltransferase (for example, AcsE), corrinoid iron-sulfur protein, nickel-protein assembly protein (for example, AcsF), ferredoxin, acetyl-CoA synthase, carbon monoxide dehydrogenase and nickel-protein assembly protein (for example, CooC). Following the teachings and guidance provided herein for introducing a sufficient number of encoding nucleic acids to generate a 4-HB, 4-HBal, 4-HBCoA, BDO or putrescine pathway, those skilled in the art will understand that the same engineering design also can be performed with respect to introducing at least the nucleic acids encoding the Wood-Ljungdahl enzymes or proteins absent in the host organism. Therefore, introduction of one or more encoding nucleic acids into the microbial organisms of the invention such that the modified organism contains the complete Wood-Ljungdahl pathway will confer syngas utilization ability.

Additionally, the reductive (reverse) tricarboxylic acid cycle coupled with carbon monoxide dehydrogenase and/or hydrogenase activities can also be used for the conversion of CO, $CO_2$ and/or $H_2$ to acetyl-CoA and other products such as acetate. Organisms capable of fixing carbon via the reductive TCA pathway can utilize one or more of the following enzymes: ATP citrate-lyase, citrate lyase, aconitase, isocitrate dehydrogenase, alpha-ketoglutarate:ferredoxin oxidoreductase, succinyl-CoA synthetase, succinyl-CoA transferase, fumarate reductase, fumarase, malate dehydrogenase, NAD(P)H:ferredoxin oxidoreductase, carbon monoxide dehydrogenase, and hydrogenase. Specifically, the reducing equivalents extracted from CO and/or $H_2$ by carbon monoxide dehydrogenase and hydrogenase are utilized to fix $CO_2$ via the reductive TCA cycle into acetyl-CoA or acetate. Acetate can be converted to acetyl-CoA by enzymes such as acetyl-CoA transferase, acetate kinase/phosphotransacetylase, and acetyl-CoA synthetase. Acetyl-CoA can be converted to the 4-HB, 4-HBal, 4-HBCoA, BDO or putrescine precursors, glyceraldehyde-3-phosphate, phosphoenolpyruvate, and pyruvate, by pyruvate:ferredoxin oxidoreductase and the enzymes of gluconeogenesis. Following the teachings and guidance provided herein for introducing a sufficient number of encoding nucleic acids to generate a 4-HB, 4-HBal, 4-HBCoA, BDO or putrescine pathway, those skilled in the art will understand that the same engineering design also can be performed with respect to introducing at least the nucleic acids encoding the reductive TCA pathway enzymes or proteins absent in the host organism. Therefore, introduction of one or more encoding nucleic acids into the microbial organisms of the invention such that the modified organism contains the complete reductive TCA pathway will confer syngas utilization ability.

Accordingly, given the teachings and guidance provided herein, those skilled in the art will understand that a non-naturally occurring microbial organism can be produced that secretes the biosynthesized compounds of the invention when grown on a carbon source such as a carbohydrate. Such compounds include, for example, 4-HB, 4-HBal, 4-HBCoA, BDO or putrescine and any of the intermediate metabolites in the 4-HB, 4-HBal, 4-HBCoA, BDO or putrescine pathway. All that is required is to engineer in one or more of the required enzyme or protein activities to achieve biosynthesis of the desired compound or intermediate including, for example, inclusion of some or all of the 4-HB, 4-HBal, 4-HBCoA, BDO or putrescine biosynthetic pathways. Accordingly, the invention provides a non-naturally occurring microbial organism that produces and/or secretes 4-HB, 4-HBal, 4-HBCoA, BDO or putrescine when grown on a carbohydrate or other carbon source and produces and/or secretes any of the intermediate metabolites shown in the 4-HB, 4-HBal, 4-HBCoA, BDO or putrescine pathway when grown on a carbohydrate or other carbon source. The 4-HB, 4-HBal, 4-HBCoA, BDO or putrescine producing microbial organisms of the invention can initiate synthesis from an intermediate in a 4-HB, 4-HBal, 4-HBCoA, BDO or putrescine pathway, as disclosed herein.

To generate better producers, metabolic modeling can be utilized to optimize growth conditions. Modeling can also be used to design gene knockouts that additionally optimize utilization of the pathway (see, for example, U.S. patent publications US 2002/0012939, US 2003/0224363, US 2004/0029149, US 2004/0072723, US 2003/0059792, US 2002/0168654 and US 2004/0009466, and U.S. Pat. No. 7,127,379). Modeling analysis allows reliable predictions of the effects on cell growth of shifting the metabolism towards more efficient production of 4-HB, 4-HBal, 4-HBCoA, BDO or putrescine.

One computational method for identifying and designing metabolic alterations favoring biosynthesis of a desired product is the OptKnock computational framework (Burgard et al., *Biotechnol. Bioeng.* 84:647-657 (2003)). OptKnock is a metabolic modeling and simulation program that suggests gene deletion strategies that result in genetically stable microorganisms which overproduce the target product. Specifically, the framework examines the complete metabolic and/or biochemical network of a microorganism in order to suggest genetic manipulations that force the desired biochemical to become an obligatory byproduct of cell growth. By coupling biochemical production with cell growth through strategically placed gene deletions or other functional gene disruption, the growth selection pressures imposed on the engineered strains after long periods of time in a bioreactor lead to improvements in performance as a result of the compulsory growth-coupled biochemical production. Lastly, when gene deletions are constructed there is a negligible possibility of the designed strains reverting to their wild-type states because the genes selected by OptKnock are to be completely removed from the genome. Therefore, this computational methodology can be used to either identify alternative pathways that lead to biosynthesis of a desired product or used in connection with the non-naturally occurring microbial organisms for further optimization of biosynthesis of a desired product.

Briefly, OptKnock is a term used herein to refer to a computational method and system for modeling cellular metabolism. The OptKnock program relates to a framework of models and methods that incorporate particular constraints into flux balance analysis (FBA) models. These constraints include, for example, qualitative kinetic information, qualitative regulatory information, and/or DNA microarray experimental data. OptKnock also computes solutions to various metabolic problems by, for example, tightening the flux boundaries derived through flux balance models and subsequently probing the performance limits of metabolic networks in the presence of gene additions or deletions. OptKnock computational framework allows the construction of model formulations that allow an effective query of the performance limits of metabolic networks and provides methods for solving the resulting mixed-integer linear programming problems. The metabolic modeling and simulation methods referred to herein as OptKnock are described in, for example, U.S. publication 2002/0168654, filed Jan. 10, 2002, in International Patent No. PCT/US002/00660, filed Jan. 10, 2002, and U.S. publication 2009/0047719, filed Aug. 10, 2007.

Another computational method for identifying and designing metabolic alterations favoring biosynthetic production of a product is a metabolic modeling and simulation system termed SimPheny®. This computational method and system is described in, for example, U.S. publication 2003/0233218, filed Jun. 14, 2002, and in International Patent Application No. PCT/US03/18838, filed Jun. 13, 2003 (WO/2003/106998). SimPheny® is a computational system that can be used to produce a network model in silico and to simulate the flux of mass, energy or charge through the chemical reactions of a biological system to define a solution space that contains any and all possible functionalities of the chemical reactions in the system, thereby determining a range of allowed activities for the biological system. This approach is referred to as constraints-based modeling because the solution space is defined by constraints such as the known stoichiometry of the included reactions as well as reaction thermodynamic and capacity constraints associated with maximum fluxes through reactions. The space defined by these constraints can be interrogated to determine the phenotypic capabilities and behavior of the biological system or of its biochemical components.

These computational approaches are consistent with biological realities because biological systems are flexible and can reach the same result in many different ways. Biological systems are designed through evolutionary mechanisms that have been restricted by fundamental constraints that all living systems must face. Therefore, constraints-based modeling strategy embraces these general realities. Further, the ability to continuously impose further restrictions on a network model via the tightening of constraints results in a reduction in the size of the solution space, thereby enhancing the precision with which physiological performance or phenotype can be predicted.

Given the teachings and guidance provided herein, those skilled in the art will be able to apply various computational frameworks for metabolic modeling and simulation to design and implement biosynthesis of a desired compound in host microbial organisms. Such metabolic modeling and simulation methods include, for example, the computational systems exemplified above as SimPheny® and OptKnock. For illustration of the invention, some methods are described herein with reference to the OptKnock computation framework for modeling and simulation. Those skilled in the art will know how to apply the identification, design and implementation of the metabolic alterations using OptKnock to any of such other metabolic modeling and simulation computational frameworks and methods well known in the art.

The methods described above will provide one set of metabolic reactions to disrupt. Elimination of each reaction within the set or metabolic modification can result in a desired product as an obligatory product during the growth phase of the organism. Because the reactions are known, a solution to the bilevel OptKnock problem also will provide the associated gene or genes encoding one or more enzymes that catalyze each reaction within the set of reactions. Identification of a set of reactions and their corresponding genes encoding the enzymes participating in each reaction is generally an automated process, accomplished through correlation of the reactions with a reaction database having a relationship between enzymes and encoding genes.

Once identified, the set of reactions that are to be disrupted in order to achieve production of a desired product are implemented in the target cell or organism by functional disruption of at least one gene encoding each metabolic reaction within the set. One particularly useful means to achieve functional disruption of the reaction set is by deletion of each encoding gene. However, in some instances, it can be beneficial to disrupt the reaction by other genetic aberrations including, for example, mutation, deletion of regulatory regions such as promoters or cis binding sites for regulatory factors, or by truncation of the coding sequence at any of a number of locations. These latter aberrations, resulting in less than total deletion of the gene set can be useful, for example, when rapid assessments of the coupling of a product are desired or when genetic reversion is less likely to occur.

To identify additional productive solutions to the above described bilevel OptKnock problem which lead to further sets of reactions to disrupt or metabolic modifications that can result in the biosynthesis, including growth-coupled biosynthesis of a desired product, an optimization method, termed integer cuts, can be implemented. This method proceeds by iteratively solving the OptKnock problem exemplified above with the incorporation of an additional constraint referred to as an integer cut at each iteration. Integer cut constraints effectively prevent the solution procedure from choosing the exact same set of reactions identified in any previous iteration that obligatorily couples product biosynthesis to growth. For example, if a previously identified growth-coupled metabolic modification specifies reactions 1, 2, and 3 for disruption, then the following constraint prevents the same reactions from being simultaneously considered in subsequent solutions. The integer cut method is well known in the art and can be found described in, for example, Burgard et al., *Biotechnol. Prog.* 17:791-797 (2001). As with all methods described herein with reference to their use in combination with the OptKnock computational framework for metabolic modeling and simulation, the integer cut method of reducing redundancy in iterative computational analysis also can be applied with other computational frameworks well known in the art including, for example, SimPheny®.

The methods exemplified herein allow the construction of cells and organisms that biosynthetically produce a desired product, including the obligatory coupling of production of a target biochemical product to growth of the cell or organism engineered to harbor the identified genetic alterations. Therefore, the computational methods described herein allow the identification and implementation of metabolic modifications that are identified by an in silico method selected from OptKnock or SimPheny®. The set of metabolic modifications can include, for example, addition of one or more biosynthetic pathway enzymes and/or functional disruption of one or more metabolic reactions including, for example, disruption by gene deletion.

As discussed above, the OptKnock methodology was developed on the premise that mutant microbial networks can be evolved towards their computationally predicted maximum-growth phenotypes when subjected to long periods of growth selection. In other words, the approach leverages an organism's ability to self-optimize under selective pressures. The OptKnock framework allows for the exhaustive enumeration of gene deletion combinations that force a coupling between biochemical production and cell growth based on network stoichiometry. The identification of optimal gene/reaction knockouts requires the solution of a bilevel optimization problem that chooses the set of active reactions such that an optimal growth solution for the resulting network overproduces the biochemical of interest (Burgard et al., *Biotechnol. Bioeng.* 84:647-657 (2003)).

An in silico stoichiometric model of *E. coli* metabolism can be employed to identify essential genes for metabolic pathways as exemplified previously and described in, for example, U.S. patent publications US 2002/0012939, US 2003/0224363, US 2004/0029149, US 2004/0072723, US 2003/0059792, US 2002/0168654 and US 2004/0009466, and in U.S. Pat. No. 7,127,379. As disclosed herein, the OptKnock mathematical framework can be applied to pinpoint gene deletions leading to the growth-coupled production of a desired product. Further, the solution of the bilevel OptKnock problem provides only one set of deletions. To enumerate all meaningful solutions, that is, all sets of knockouts leading to growth-coupled production formation, an optimization technique, termed integer cuts, can be implemented. This entails iteratively solving the OptKnock problem with the incorporation of an additional constraint referred to as an integer cut at each iteration, as discussed above.

Employing the methods exemplified above and herein, the methods of the invention allow the construction of cells and organisms that increase production of a desired product, for example, by coupling the production of a desired product to growth of the cell or organism engineered to harbor the identified genetic alterations. As disclosed herein, metabolic alterations have been identified that couple the production of 4-HB, 4-HBal, 4-HBCoA, BDO or putrescine to growth of the organism. Microbial organism strains constructed with the identified metabolic alterations produce elevated levels, relative to the absence of the metabolic alterations, of 4-HB, 4-HBal, 4-HBCoA, BDO or putrescine during the exponential growth phase. These strains can be beneficially used for the commercial production of 4-HB, 4-HBal, 4-HBCoA, BDO or putrescine in continuous fermentation process without being subjected to the negative selective pressures described previously. Although exemplified herein as metabolic alterations, in particular one or more gene disruptions, that confer growth coupled production of 4-HB, 4-HBal, 4-HBCoA, BDO or putrescine, it is understood that any gene disruption that increases the production of 4-HB, 4-HBal, 4-HBCoA, BDO or putrescine can be introduced into a host microbial organism, as desired.

Therefore, the methods of the invention provide a set of metabolic modifications that are identified by an in silico method such as OptKnock. The set of metabolic modifications can include functional disruption of one or more metabolic reactions including for example, disruption by gene deletion. For 4-HB, 4-HBal, 4-HBCoA, BDO or putrescine production, metabolic modifications can be selected from the set of metabolic modifications described herein, including the Examples.

Also provided is a method of producing a non-naturally occurring microbial organisms having stable growth-coupled production of 4-HB, 4-HBal, 4-HBCoA, BDO or putrescine. The method can include identifying in silico a set of metabolic modifications that increase production of 4-HB, 4-HBal, 4-HBCoA, BDO or putrescine, for example, increase production during exponential growth; genetically modifying an organism to contain the set of metabolic modifications that increase production of 4-HB, 4-HBal, 4-HBCoA, BDO or putrescine, and culturing the genetically modified organism. If desired, culturing can include adaptively evolving the genetically modified organism under conditions requiring production of 4-HB, 4-HBal, 4-HBCoA, BDO or putrescine. The methods of the invention are applicable to bacterium, yeast and fungus as well as a variety of other cells and microorganism, as disclosed herein.

Thus, the invention provides a non-naturally occurring microbial organism comprising one or more gene disruptions that confer increased production of 4-HB, 4-HBal, 4-HBCoA, BDO or putrescine. In one embodiment, the one or more gene disruptions confer growth-coupled production of 4-HB, 4-HBal, 4-HBCoA, BDO or putrescine, and can, for example, confer stable growth-coupled production of 4-HB, 4-HBal, 4-HBCoA, BDO or putrescine. In another embodiment, the one or more gene disruptions can confer obligatory coupling of 4-HB, 4-HBal, 4-HBCoA, BDO or putrescine production to growth of the microbial organism. Such one or more gene disruptions reduce the activity of the respective one or more encoded enzymes.

The non-naturally occurring microbial organism can have one or more gene disruptions included in a metabolic modification as described herein. As disclosed herein, the one or more gene disruptions can be a deletion. Such non-naturally occurring microbial organisms of the invention include bacteria, yeast, fungus, or any of a variety of other microorganisms applicable to fermentation processes, as disclosed herein.

Thus, the invention provides a non-naturally occurring microbial organism, comprising one or more gene disruptions, where the one or more gene disruptions occur in genes encoding proteins or enzymes where the one or more gene disruptions confer increased production of 4-HB, 4-HBal, 4-HBCoA, BDO or putrescine in the organism. The production of 4-HB, 4-HBal, 4-HBCoA, BDO or putrescine can be growth-coupled or not growth-coupled. In a particular embodiment, the production of 4-HB, 4-HBal, 4-HBCoA, BDO or putrescine can be obligatorily coupled to growth of the organism, as disclosed herein.

The invention provides non naturally occurring microbial organisms having genetic alterations such as gene disruptions that increase production of 4-HB, 4-HBal, 4-HBCoA, BDO or putrescine, for example, growth-coupled production of 4-HB, 4-HBal, 4-HBCoA, BDO or putrescine. Product production can be, for example, obligatorily linked to the exponential growth phase of the microorganism by genetically altering the metabolic pathways of the cell, as disclosed herein. The genetic alterations can increase the production of the desired product or even make the desired product an obligatory product during the growth phase. Sets of metabolic alterations or transformations that result in increased production and elevated levels of 4-HB, 4-HBal, 4-HBCoA, BDO or putrescine biosynthesis are described herein. Each alteration within a set corresponds to the requisite metabolic reaction that should be functionally disrupted. Functional disruption of all reactions within each set can result in the increased production of 4-HB, 4-HBal, 4-HBCoA, BDO or putrescine by the engineered strain during the growth phase.

A number of metabolic modifications that include gene disruptions are described herein. It is understood by those skilled in the art that one or more of the metabolic modifications, including gene disruptions, can be combined to increase 4-HB, 4-HBal, 4-HBCoA, BDO or putrescine or otherwise improve characteristics of the microorganisms of th invention. Each of these non-naturally occurring alterations can result in increased production and an enhanced level of 4-HB, 4-HBal, 4-HBCoA, BDO or putrescine production, for example, during the exponential growth phase of the microbial organism, or otherwise improve the growth or production characteristics of the microorganisms producing 4-HB, 4-HBal, 4-HBCoA, BDO or putrescine compared to a strain that does not contain such metabolic alterations, under appropriate culture conditions. Appropriate conditions include, for example, those disclosed herein, including conditions such as particular carbon sources or reactant availabilities and/or adaptive evolution.

Given the teachings and guidance provided herein, those skilled in the art will understand that to introduce a metabolic alteration such as disruption or attenuation of an enzyme or enzymatic reaction, it can be necessary to disrupt the catalytic activity of the one or more enzymes involved in the reaction. Alternatively, a metabolic alteration can include disruption of expression of a regulatory protein or cofactor necessary for enzyme activity or maximal activity. Furthermore, genetic loss of a cofactor necessary for an enzymatic reaction can also have the same effect as a disruption of the gene encoding the enzyme. Disruption can occur by a variety of methods including, for example, deletion of an encoding gene or incorporation of a genetic alteration in one or more of the encoding gene sequences. The encoding genes targeted for disruption can be one, some, or all of the genes encoding enzymes involved in the catalytic activity. For example, where a single enzyme is involved in a targeted catalytic activity, disruption can occur by a genetic alteration that reduces or eliminates the catalytic activity of the encoded gene product. Similarly, where the single enzyme is multimeric, including heteromeric, disruption can occur by a genetic alteration that reduces or destroys the function of one or all subunits of the encoded gene products. Destruction of activity can be accomplished by loss of the binding activity of one or more subunits required to form an active complex, by destruction of the catalytic subunit of the multimeric complex or by both. Other functions of multimeric protein association and activity also can be targeted in order to disrupt a metabolic reaction of the invention. Such other functions are well known to those skilled in the art. Similarly, a target enzyme activity can be reduced or eliminated by disrupting expression of a protein or enzyme that modifies and/or activates the target enzyme, for example, a molecule required to convert an apoenzyme to a holoenzyme. Further, some or all of the functions of a single polypeptide or multimeric complex can be disrupted according to the invention in order to reduce or abolish the catalytic activity of one or more enzymes involved in a reaction or metabolic modification of the invention. Similarly, some or all of enzymes involved in a reaction or metabolic modification of the invention can be disrupted so long as the targeted reaction is reduced or eliminated.

Given the teachings and guidance provided herein, those skilled in the art also will understand that an enzymatic reaction can be disrupted by reducing or eliminating reactions encoded by a common gene and/or by one or more orthologs of that gene exhibiting similar or substantially the same activity. Reduction of both the common gene and all orthologs can lead to complete abolishment of any catalytic activity of a targeted reaction. However, disruption of either the common gene or one or more orthologs can lead to a reduction in the catalytic activity of the targeted reaction sufficient to promote coupling of growth to product biosynthesis. Exemplified herein are both the common genes encoding catalytic activities for a variety of metabolic modifications as well as their orthologs. Those skilled in the art will understand that disruption of some or all of the genes encoding a enzyme of a targeted metabolic reaction can be practiced in the methods of the invention and incorporated into the non-naturally occurring microbial organisms of the invention in order to achieve the increased production of 4-HB, 4-HBal, 4-HBCoA, BDO or putrescine or growth-coupled product production.

Given the teachings and guidance provided herein, those skilled in the art also will understand that enzymatic activity or expression can be attenuated using well known methods. Reduction of the activity or amount of an enzyme can mimic complete disruption of a gene if the reduction causes activity of the enzyme to fall below a critical level that is normally required for a pathway to function. Reduction of enzymatic activity by various techniques rather than use of gene disruption can be important for an organism's viability. Methods of reducing enzymatic activity that result in similar or identical effects of a gene disruption include, but are not limited to: reducing gene transcription or translation; destabilizing mRNA, protein or catalytic RNA; and mutating a gene that affects enzyme activity or kinetics (see Sambrook et al., *Molecular Cloning. A Laboratory Manual*, Third Ed., Cold Spring Harbor Laboratory, New York (2001); and Ausubel et al., *Current Protocols in Molecular Biology*, John Wiley and Sons, Baltimore, MD (1999). Natural or imposed regulatory controls can also accomplish enzyme attenuation including: promoter replacement (see Wang et al., *Mol. Biotechnol.* 52(2):300-308 (2012)); loss or alteration of transcription factors (Dietrick et al., *Annu. Rev Biochem.* 79:563-590 (2010); and Simicevic et al., *Mol. Biosyst.* 6(3):462-468 (2010)); introduction of inhibitory RNAs or peptides such as siRNA, antisense RNA, RNA or peptide/small-molecule binding aptamers, ribozymes, aptazymes and riboswitches (Wieland et al., *Methods* 56(3): 351-357 (2012); O'Sullivan, *Anal. Bioanal. Chem.* 372(1): 44-48 (2002); and Lee et al., *Curr. Opin. Biotechnol.* 14(5):505-511 (2003)); and addition of drugs or other chemicals that reduce or disrupt enzymatic activity such as splicing an enzyme inhibitor, an antibiotic or a target-specific drug.

One skilled in the art will also understand and recognize that attenuation of an enzyme can be done at various levels. For example, at the gene level, a mutation causing a partial or complete null phenotype, such as a gene disruption or a mutation causing epistatic genetic effects that mask the activity of a gene product (Miko, *Nature Education* 1(1) (2008)) can be used to attenuate an enzyme. At the gene expression level, methods for attenuation include: coupling transcription to an endogenous or exogenous inducer such as isopropylthio-β-galactoside (IPTG), then adding low amounts of inducer or no inducer during the production phase (Donovan et al., *J. Ind. Microbiol.* 16(3):145-154 (1996); and Hansen et al., *Curr Microbiol.* 36(6):341-347 (1998)); introducing or modifying a positive or a negative regulator of a gene; modify histone acetylation/deacetylation in a eukaryotic chromosomal region where a gene is integrated (Yang et al., *Curr Opin. Genet. Dev.* 13(2):143-153 (2003) and Kurdistani et al., *Nat. Rev. Mol. Cell Biol.* 4(4):276-284 (2003)); introducing a transposition to disrupt a promoter or a regulatory gene (Bleykasten-Brosshans et al., *C. R. Biol.* 33(8-9):679-686 (2011); and McCue et al., *PLoS Genet.* 8(2):e1002474 (2012)); flipping the orientation of a transposable element or promoter region so as to modulate gene expression of an adjacent gene (Wang et al., *Genetics* 120(4):875-885 (1988); Hayes, *Annu. Rev. Genet.* 37:3-29 (2003); in a diploid organism, deleting one allele resulting in loss of heterozygosity (Daigaku et al., *Mutation Research/Fundamental and Molecular Mechanisms of Mutagenesis* 600(1-2)177-183 (2006)); introducing nucleic acids that increase RNA degradation (Houseley et al., *Cell* 136(4):763-776 (2009)); or in bacteria, for example, introduction of a transfer-messenger RNA (tmRNA) tag, which can lead to RNA degradation and ribosomal stalling (Sunohara et al., *RNA* 10(3):378-386 (2004); and Sunohara et al., *J. Biol. Chem.* 279:15368-15375 (2004)). At the translational level, attenuation can include: introducing rare codons to limit translation (Angov, *Biotechnol. J.* 6(6):650-659 (2011)); introducing RNA interference molecules that block translation (Castel et al., *Nat. Rev Genet.* 14(2):100-112 (2013); and Kawasaki et al., *Curr Opin. Mol. Ther.* 7(2): 125-131 (2005)); modifying regions outside the coding sequence, such as introducing secondary structure into an untranslated region (UTR) to block translation or reduce efficiency of translation (Ringnér et al., *PLoS Comput. Biol.* 1(7):e72 (2005)); adding RNAase sites for rapid transcript degradation (Pasquinelli, *Nat. Rev. Genet.* 13(4):271-282 (2012); and Arraiano et al., *FEMS Microbiol. Rev.* 34(5): 883-932 (2010)); introducing antisense RNA oligomers or antisense transcripts (Nashizawa et al., *Front. Biosci.* 17:938-958 (2012)); introducing RNA or peptide aptamers, ribozymes, aptazymes, riboswitches (Wieland et al., *Methods* 56(3):351-357 (2012); O'Sullivan, *Anal. Bioanal. Chem.* 372(1):44-48 (2002); and Lee et al., *Curr Opin. Biotechnol.* 14(5):505-511 (2003)); or introducing translational regulatory elements involving RNA structure that can prevent or reduce translation that can be controlled by the presence or absence of small molecules (Araujo et al., *Comparative and Functional Genomics, Article ID* 475731, 8 pages (2012)). At the level of enzyme localization and/or longevity, enzyme attenuation can include: adding a degradation tag for faster protein turnover (Hochstrasser, *Annual Rev. Genet.* 30:405-439 (1996); and Yuan et al., *PLoS One* 8(4):e62529 (2013)); or adding a localization tag that results in the enzyme being secreted or localized to a subcellular compartment in a eukaryotic cell where the enzyme would not be able to react with its normal substrate (Nakai et al. Genomics 14(4):897-911 (1992); and Russell et al., *J. Bact.* 189(21)7581-7585 (2007)). At the level of post-translational regulation, enzyme attenuation can include: increasing intracellular concentration of known inhibitors; or modifying post-translational modified sites (Mann et al., *Nature Biotech.* 21:255-261 (2003)). At the level of enzyme activity, enzyme attenuation can include: adding an endogenous or an exogenous inhibitor, such as an enzyme inhibitor, an antibiobic, or a target-specific drug, to reduce enzyme activity; limiting availability of essential cofactors, such as vitamin B12, for an enzyme that requires the cofactor; chelating a metal ion that is required for enzyme activity; or introducing a dominant negative mutation. The applicability of a technique for attenuation described above can depend upon whether a given host microbial organism is prokaryotic or eukaryotic, and it is understand that a determination of what is the appropriate technique for a given host can be readily made by one skilled in the art.

In some embodiments, microaerobic designs can be used based on the growth-coupled formation of the desired product. To examine this, production cones can be constructed for each strategy by first maximizing and, subsequently minimizing the product yields at different rates of biomass formation feasible in the network. If the rightmost boundary of all possible phenotypes of the mutant network is a single point, it implies that there is a unique optimum yield of the product at the maximum biomass formation rate possible in the network. In other cases, the rightmost boundary of the feasible phenotypes is a vertical line, indicating that at the point of maximum biomass the network can make any amount of the product in the calculated range, including the lowest amount at the bottommost point of the vertical line. Such designs are given a low priority.

The 4-HB, 4-HBal, 4-HBCoA, BDO or putrescine production strategies identified by the methods disclosed herein such as the OptKnock framework are generally ranked on the basis of their (i) theoretical yields, and optionally (ii) growth-coupled 4-HB, 4-HBal, 4-HBCoA, BDO or putrescine formation characteristics.

Accordingly, the invention also provides a non-naturally occurring microbial organism having a set of metabolic modifications that increase the yield of 4-HB, 4-HBal, 4-HBCoA, BDO or putrescine, optionally coupling 4-HB, 4-HBal, 4-HBCoA, BDO or putrescine production to growth of the organism, or otherwise improve characteristics of the microorganisms producing 4-HB, 4-HBal, 4-HBCoA, BDO or putrescine, where the set of metabolic modifications includes disruption of one or more genes, as described herein.

Each of the strains can be supplemented with additional deletions if it is determined that the strain designs do not sufficiently increase the production of 4-HB, 4-HBal, 4-HB-CoA, BDO or putrescine and/or couple the formation of the product with biomass formation. Alternatively, some other enzymes not known to possess significant activity under the growth conditions can become active due to adaptive evolution or random mutagenesis. Such activities can also be knocked out. However, the list of gene deletion sets disclosed herein allows the construction of strains exhibiting high-yield production of 4-HB, 4-HBal, 4-HBCoA, BDO or putrescine, including growth-coupled production of 4-HB, 4-HBal, 4-HBCoA, BDO or putrescine.

4-HB, 4-HBal, 4-HBCoA, BDO or putrescine can be harvested or isolated at any time point during the culturing of the microbial organism, for example, in a continuous and/or near-continuous culture period, as disclosed herein. Generally, the longer the microorganisms are maintained in a continuous and/or near-continuous growth phase, the proportionally greater amount of 4-HB, 4-HBal, 4-HBCoA, BDO or putrescine can be produced.

Therefore, the invention additionally provides a method for producing 4-HB, 4-HBal, 4-HBCoA, BDO or putrescine that includes culturing a non-naturally occurring microbial organism having one or more gene disruptions, as disclosed herein. The disruptions can occur in one or more genes encoding an enzyme that increases production of 4-HB, 4-HBal, 4-HBCoA, BDO or putrescine, including optionally coupling 4-HB, 4-HBal, 4-HBCoA, BDO or putrescine production to growth of the microorganism when the gene disruption reduces or eliminates an activity of the enzyme. For example, the disruptions can confer stable growth-coupled production of 4-HB, 4-HBal, 4-HBCoA, BDO or putrescine onto the non-naturally occurring microbial organism.

In some embodiments, the gene disruption can include a complete gene deletion. In some embodiments other methods to disrupt a gene include, for example, frameshifting by omission or addition of oligonucleotides or by mutations that render the gene inoperable. One skilled in the art will recognize the advantages of gene deletions, however, because of the stability it confers to the non-naturally occurring organism from reverting to a parental phenotype in which the gene disruption has not occurred. In particular, the gene disruptions are selected from the gene sets as disclosed herein.

Once computational or other predictions are made of one or more genes sets disruption to increase production of 4-HB, 4-HBal, 4-HBCoA, BDO or putrescine, the strains can be constructed, evolved, and tested. Gene disruptions, including gene deletions, are introduced into host organism by methods well known in the art. A particularly useful method for gene disruption is by homologous recombination, as disclosed herein.

The engineered strains can be characterized by measuring the growth rate, the substrate uptake rate, and/or the product/byproduct secretion rate. Cultures can be grown and used as inoculum for a fresh batch culture for which measurements are taken during exponential growth. The growth rate can be determined by measuring optical density using a spectrophotometer (A600). Concentrations of glucose and other organic acid byproducts in the culture supernatant can be determined by well known methods such as HPLC, GC-MS or other well known analytical methods suitable for the analysis of the desired product, as disclosed herein, and used to calculate uptake and secretion rates.

Strains containing gene disruptions can exhibit suboptimal growth rates until their metabolic networks have adjusted to their missing functionalities. To assist in this adjustment, the strains can be adaptively evolved. By subjecting the strains to adaptive evolution, cellular growth rate becomes the primary selection pressure and the mutant cells are compelled to reallocate their metabolic fluxes in order to enhance their rates of growth. This reprogramming of metabolism has been recently demonstrated for several *E. coli* mutants that had been adaptively evolved on various substrates to reach the growth rates predicted a priori by an in silico model (Fong and Palsson, *Nat. Genet.* 36:1056-1058 (2004)). The growth improvements brought about by adaptive evolution can be accompanied by enhanced rates of 4-HB, 4-HBal, 4-HBCoA, BDO or putrescine production. The strains can optionally be adaptively evolved in replicate, running in parallel, to account for differences in the evolutionary patterns that can be exhibited by a host organism (Fong and Palsson, *Nat. Genet.* 36:1056-1058 (2004); Fong et al., *J. Bacteriol.* 185:6400-6408 (2003); Ibarra et al., *Nature* 420:186-189 (2002)) that could potentially result in one strain having superior production qualities over the others. Evolutions can be run for a period of time, typically 2-6 weeks, depending upon the rate of growth improvement attained. In general, evolutions are stopped once a stable phenotype is obtained.

Following the adaptive evolution process, the new strains are characterized again by measuring the growth rate, the substrate uptake rate, and the product/byproduct secretion rate. These results are compared to the theoretical predictions by plotting actual growth and production yields along side the production envelopes from metabolic modeling. The most successful design/evolution combinations are chosen to pursue further, and are characterized in lab-scale batch and continuous fermentations. The growth-coupled biochemical production concept behind the methods disclosed herein such as OptKnock approach should also result in the generation of genetically stable overproducers. Thus, the cultures are maintained in continuous mode for an extended period of time, for example, one month or more, to evaluate long-term stability. Periodic samples can be taken to ensure that yield and productivity are maintained.

Adaptive evolution is a powerful technique that can be used to increase growth rates of mutant or engineered microbial strains, or of wild-type strains growing under unnatural environmental conditions. It is especially useful for strains designed via methods such as OptKnock, which results in growth-coupled product formation. Therefore, evolution toward optimal growing strains will indirectly optimize production as well. Unique strains of E. coli K-12 MG1655 were created through gene knockouts and adaptive evolution. (Fong and Palsson, Nat. Genet. 36:1056-1058 (2004)). In this work, all adaptive evolutionary cultures were maintained in prolonged exponential growth by serial passage of batch cultures into fresh medium before the stationary phase was reached, thus rendering growth rate as the primary selection pressure. Knockout strains were constructed and evolved on minimal medium supplemented with different carbon substrates (four for each knockout strain). Evolution cultures were carried out in duplicate or triplicate, giving a total of 50 evolution knockout strains. The evolution cultures were maintained in exponential growth until a stable growth rate was reached. The computational predictions were accurate (within 10%) at predicting the post-evolution growth rate of the knockout strains in 38 out of the 50 cases examined. Furthermore, a combination of OptKnock design with adaptive evolution has led to improved lactic acid production strains. (Fong et al., Biotechnol. Bioeng. 91:643-648 (2005)). Similar methods can be applied to the strains disclosed herein and applied to various host strains.

There are a number of developed technologies for carrying out adaptive evolution. Exemplary methods are disclosed herein. In some embodiments, optimization of a non-naturally occurring organism of the present invention includes utilizing adaptive evolution techniques to increase 4-HB, 4-HBal, 4-HBCoA, BDO or putrescine production and/or stability of the producing strain.

Serial culture involves repetitive transfer of a small volume of grown culture to a much larger vessel containing fresh growth medium. When the cultured organisms have grown to saturation in the new vessel, the process is repeated. This method has been used to achieve the longest demonstrations of sustained culture in the literature (Lenski and Travisano, Proc. Natl. Acad Sci. USA 91:6808-6814 (1994)) in experiments which clearly demonstrated consistent improvement in reproductive rate over a period of years. Typically, transfer of cultures is usually performed during exponential phase, so each day the transfer volume is precisely calculated to maintain exponential growth through the next 24 hour period. Manual serial dilution is inexpensive and easy to parallelize.

In continuous culture the growth of cells in a chemostat represents an extreme case of dilution in which a very high fraction of the cell population remains. As a culture grows and becomes saturated, a small proportion of the grown culture is replaced with fresh media, allowing the culture to continually grow at close to its maximum population size. Chemostats have been used to demonstrate short periods of rapid improvement in reproductive rate (Dykhuizen, Methods Enzymol. 613-631 (1993)). The potential usefulness of these devices was recognized, but traditional chemostats were unable to sustain long periods of selection for increased reproduction rate, due to the unintended selection of dilution-resistant (static) variants. These variants are able to resist dilution by adhering to the surface of the chemostat, and by doing so, outcompete less adherent individuals, including those that have higher reproductive rates, thus obviating the intended purpose of the device (Chao and Ramsdell, J. Gen. Microbiol 20:132-138 (1985)). One possible way to overcome this drawback is the implementation of a device with two growth chambers, which periodically undergo transient phases of sterilization, as described previously (Marliere and Mutzel, U.S. Pat. No. 6,686,194).

Evolugator™ is a continuous culture device developed by Evolugate, LLC (Gainesville, FL) and exhibits significant time and effort savings over traditional evolution techniques (de Crecy et al., Appl. Microbiol. Biotechnol. 77:489-496 (2007)). The cells are maintained in prolonged exponential growth by the serial passage of batch cultures into fresh medium before the stationary phase is attained. By automating optical density measurement and liquid handling, the Evolugator™ can perform serial transfer at high rates using large culture volumes, thus approaching the efficiency of a chemostat in evolution of cell fitness. For example, a mutant of Acinetobacter sp ADP1 deficient in a component of the translation apparatus, and having severely hampered growth, was evolved in 200 generations to 80% of the wild-type growth rate. However, in contrast to the chemostat which maintains cells in a single vessel, the machine operates by moving from one "reactor" to the next in subdivided regions of a spool of tubing, thus eliminating any selection for wall-growth. The transfer volume is adjustable, and normally set to about 50%. A drawback to this device is that it is large and costly, thus running large numbers of evolutions in parallel is not practical. Furthermore, gas addition is not well regulated, and strict anaerobic conditions are not maintained with the current device configuration. Nevertheless, this is an alternative method to adaptively evolve a production strain.

As disclosed herein, a nucleic acid encoding a desired activity of a 4-HB, 4-HBal, 4-HBCoA, BDO or putrescine pathway can be introduced into a host organism. In some cases, it can be desirable to modify an activity of a 4-HB, 4-HBal, 4-HBCoA BDO or putrescine pathway enzyme or protein to increase production of 4-HB, 4-HBal, 4-HBCoA BDO or putrescine. For example, known mutations that increase the activity of a protein or enzyme can be introduced into an encoding nucleic acid molecule. Additionally, optimization methods can be applied to increase the activity of an enzyme or protein and/or decrease an inhibitory activity, for example, decrease the activity of a negative regulator.

One such optimization method is directed evolution. Directed evolution is a powerful approach that involves the introduction of mutations targeted to a specific gene in order to improve and/or alter the properties of an enzyme. Improved and/or altered enzymes can be identified through the development and implementation of sensitive high-throughput screening assays that allow the automated screening of many enzyme variants (for example, $>10^4$). Iterative rounds of mutagenesis and screening typically are performed to afford an enzyme with optimized properties. Computational algorithms that can help to identify areas of the gene for mutagenesis also have been developed and can significantly reduce the number of enzyme variants that need to be generated and screened. Numerous directed evolution technologies have been developed (for reviews, see Hibbert et al., Biomol. Eng 22:11-19 (2005); Huisman and Lalonde, In Biocatalysis in the pharmaceutical and biotechnology industries pgs. 717-742 (2007), Patel (ed.), CRC Press; Otten and Quax. Biomol. Eng 22:1-9 (2005); and Sen et al., Appl Biochem. Biotechnol 143:212-223 (2007)) to be effective at creating diverse variant libraries, and these methods have been successfully applied to the improvement of a wide range of properties across many enzyme classes. Enzyme characteristics that have been improved and/or altered by directed evolution technologies include, for example: selectivity/specificity, for conversion of non-natural substrates; temperature stability, for robust high temperature processing; pH stability, for bioprocessing under lower or higher pH conditions; substrate or product tolerance, so that high product titers can be achieved; binding ($K_m$), including broadening substrate binding to include non-natural substrates; inhibition ($K_i$), to remove inhibition by products, substrates, or key intermediates; activity (kcat), to increases enzymatic reaction rates to achieve desired flux; expression levels, to increase protein yields and overall pathway flux; oxygen stability, for operation of air sensitive enzymes under aerobic conditions; and anaerobic activity, for operation of an aerobic enzyme in the absence of oxygen.

A number of exemplary methods have been developed for the mutagenesis and diversification of genes to target desired properties of specific enzymes. Such methods are well known to those skilled in the art. Any of these can be used to alter and/or optimize the activity of a 4-HB, 4-HBal, 4-HBCoA, BDO or putrescine pathway enzyme or protein. Such methods include, but are not limited to EpPCR, which introduces random point mutations by reducing the fidelity of DNA polymerase in PCR reactions (Pritchard et al., *J Theor. Biol.* 234:497-509 (2005)); Error-prone Rolling Circle Amplification (epRCA), which is similar to epPCR except a whole circular plasmid is used as the template and random 6-mers with exonuclease resistant thiophosphate linkages on the last 2 nucleotides are used to amplify the plasmid followed by transformation into cells in which the plasmid is re-circularized at tandem repeats (Fujii et al., *Nucleic Acids Res.* 32:e145 (2004); and Fujii et al., *Nat. Protoc.* 1:2493-2497 (2006)); DNA or Family Shuffling, which typically involves digestion of two or more variant genes with nucleases such as Dnase I or EndoV to generate a pool of random fragments that are reassembled by cycles of annealing and extension in the presence of DNA polymerase to create a library of chimeric genes (Stemmer, *Proc Natl Acad Sci USA* 91:10747-10751 (1994); and Stemmer, *Nature* 370:389-391 (1994)); Staggered Extension (StEP), which entails template priming followed by repeated cycles of 2 step PCR with denaturation and very short duration of annealing/extension (as short as 5 sec) (Zhao et al., *Nat. Biotechnol.* 16:258-261 (1998)); Random Priming Recombination (RPR), in which random sequence primers are used to generate many short DNA fragments complementary to different segments of the template (Shao et al., *Nucleic Acids Res* 26:681-683 (1998)).

Additional methods include Heteroduplex Recombination, in which linearized plasmid DNA is used to form heteroduplexes that are repaired by mismatch repair (Volkov et al, *Nucleic Acids Res.* 27:e18 (1999); and Volkov et al., *Methods Enzymol.* 328:456-463 (2000)); Random Chimeragenesis on Transient Templates (RACHITT), which employs Dnase I fragmentation and size fractionation of single stranded DNA (ssDNA) (Coco et al., *Nat. Biotechnol.* 19:354-359 (2001)); Recombined Extension on Truncated templates (RETT), which entails template switching of unidirectionally growing strands from primers in the presence of unidirectional ssDNA fragments used as a pool of templates (Lee et al., *J. Molec. Catalysis* 26:119-129 (2003)); Degenerate Oligonucleotide Gene Shuffling (DOGS), in which degenerate primers are used to control recombination between molecules; (Bergquist and Gibbs, *Methods Mol. Biol* 352:191-204 (2007); Bergquist et al., *Biomol. Eng* 22:63-72 (2005); Gibbs et al., *Gene* 271:13-20 (2001)); Incremental Truncation for the Creation of Hybrid Enzymes (ITCHY), which creates a combinatorial library with 1 base pair deletions of a gene or gene fragment of interest (Ostermeier et al., *Proc. Natl. Acad Sci. USA* 96:3562-3567 (1999); and Ostermeier et al., *Nat. Biotechnol.* 17:1205-1209 (1999)); Thio-Incremental Truncation for the Creation of Hybrid Enzymes (THIO-ITCHY), which is similar to ITCHY except that phosphothioate dNTPs are used to generate truncations (Lutz et al., *Nucleic Acids Res* 29:E16 (2001)); SCRATCHY, which combines two methods for recombining genes, ITCHY and DNA shuffling (Lutz et al., *Proc. Natl. Acad Sci. USA* 98:11248-11253 (2001)); Random Drift Mutagenesis (RNDM), in which mutations made via epPCR are followed by screening/selection for those retaining usable activity (Bergquist et al., *Biomol. Eng.* 22:63-72 (2005)); Sequence Saturation Mutagenesis (SeSaM), a random mutagenesis method that generates a pool of random length fragments using random incorporation of a phosphothioate nucleotide and cleavage, which is used as a template to extend in the presence of "universal" bases such as inosine, and replication of an inosine-containing complement gives random base incorporation and, consequently, mutagenesis (Wong et al., *Biotechnol. J.* 3:74-82 (2008); Wong et al., *Nucleic Acids Res.* 32:e26 (2004); and Wong et al., *Anal. Biochem.* 341:187-189 (2005)); Synthetic Shuffling, which uses overlapping oligonucleotides designed to encode "all genetic diversity in targets" and allows a very high diversity for the shuffled progeny (Ness et al., *Nat. Biotechnol.* 20:1251-1255 (2002)); Nucleotide Exchange and Excision Technology NexT, which exploits a combination of dUTP incorporation followed by treatment with uracil DNA glycosylase and then piperidine to perform endpoint DNA fragmentation (Muller et al., *Nucleic Acids Res.* 33:e17 (2005)).

Further methods include Sequence Homology-Independent Protein Recombination (SHIPREC), in which a linker is used to facilitate fusion between two distantly related or unrelated genes, and a range of chimeras is generated between the two genes, resulting in libraries of single-crossover hybrids (Sieber et al., *Nat. Biotechnol.* 19:456-460 (2001)); Gene Site Saturation Mutagenesis™ (GSSM™), in which the starting materials include a supercoiled double stranded DNA (dsDNA) plasmid containing an insert and two primers which are degenerate at the desired site of mutations (Kretz et al., *Methods Enzymol.* 388:3-11 (2004)); Combinatorial Cassette Mutagenesis (CCM), which involves the use of short oligonucleotide cassettes to replace limited regions with a large number of possible amino acid sequence alterations (Reidhaar-Olson et al. *Methods Enzymol.* 208:564-586 (1991); and Reidhaar-Olson et al. *Science* 241:53-57 (1988)); Combinatorial Multiple Cassette Mutagenesis (CMCM), which is essentially similar to CCM and uses epPCR at high mutation rate to identify hot spots and hot regions and then extension by CMCM to cover a defined region of protein sequence space (Reetz et al., *Angew. Chem. Int. Ed Engl.* 40:3589-3591 (2001)); the Mutator Strains technique, in which conditional ts mutator plasmids, utilizing the mutD5 gene, which encodes a mutant subunit of DNA polymerase III, to allow increases of 20 to 4000-X in random and natural mutation frequency during selection and block accumulation of deleterious mutations when selection is not required (Selifonova et al., *Appl. Environ. Microbiol.* 67:3645-3649 (2001); Low et al., *J. Mol. Biol.* 260:359-3680 (1996)).

Additional exemplary methods include Look-Through Mutagenesis (LTM), which is a multidimensional mutagenesis method that assesses and optimizes combinatorial mutations of selected amino acids (Rajpal et al., *Proc. Natl. Acad Sci. USA* 102:8466-8471 (2005)); Gene Reassembly, which is a DNA shuffling method that can be applied to multiple genes at one time or to create a large library of chimeras (multiple mutations) of a single gene (Tunable GeneReassembly™ (TGR™) Technology supplied by Verenium Corporation), in Silico Protein Design Automation (PDA), which is an optimization algorithm that anchors the structurally defined protein backbone possessing a particular fold, and searches sequence space for amino acid substitutions that can stabilize the fold and overall protein energetics, and generally works most effectively on proteins with known three-dimensional structures (Hayes et al., *Proc. Natl. Acad Sci. USA* 99:15926-15931 (2002)); and Iterative Saturation Mutagenesis (ISM), which involves using knowledge of structure/function to choose a likely site for enzyme improvement, performing saturation mutagenesis at chosen site using a mutagenesis method such as Stratagene QuikChange (Stratagene; San Diego CA), screening/selecting for desired properties, and, using improved clone(s), starting over at another site and continue repeating until a desired activity is achieved (Reetz et al., *Nat. Protoc.* 2:891-903 (2007); and Reetz et al., *Angew. Chem. Int. Ed Engl.* 45:7745-7751 (2006)).

Any of the aforementioned methods for mutagenesis can be used alone or in any combination. Additionally, any one or combination of the directed evolution methods can be used in conjunction with adaptive evolution techniques, as described herein.

As disclosed herein, esterases were utilized to convert gamma-butyrolactone to 4-hydroxybutyrate. Exemplary esterases include, but are not limited to, esterases from *Yersinia intermedia* 29909 (locus yinte0001_13710) and *Agrobacterium tumefaciens* str. C58 (Carlier et al., *Mol. Plant Microbe Interact.* 17(9):951-957 (2004))(see Example XXXIV). The nucleotide sequence and amino acid sequence of the *Yersinia* gene (locus yinte0001_13710) is shown in FIG. 89 (see also GenBank ZP_04636075.1; GI:238792441). The nucleotide and amino acid sequence of the gene from *Agrobacterium tumefaciens* is shown in FIG. 90. Additionally exemplary esterases include AttM of *Escherichia coli* KTE10 (GenBank ZP_19612688.1, GI:432369596) and attM of *Photorhabdus asymbiotica* (GenBank YP_003039319.1 GI:253987963).

The invention additionally provides a method for reducing gamma-butyrolactone production in a cell or cell culture by expressing in the cell a gamma-butyrolactone esterase. The gamma-butyrolactone esterase can be, for example, a gamma-butyrolactone esterase of *Yersinia* or a polypeptide having at least 90% identity to a gamma-butyrolactone esterase of *Yersinia*. In a particular embodiment, the gamma-butyrolactone esterase is encoded by a nucleic acid encoding the amino acid sequence of SEQ ID NO:, or a nucleic acid encoding a polypeptide having at least 90% identity to SEQ ID NO:. The invention further provides utilizing a gamma-butyrolactone esterase to decrease the amount of gamma-butyrolactone in a sample in vitro.

In some embodiments, the invention provides an isolated nucleic acid molecule selected from: (a) a nucleic acid molecule encoding an amino acid sequence disclosed herein, such as those referenced in Tables 53, 55 or 57 or Example XXXXIII, wherein the amino acid sequence comprises one or more variant amino acid positions disclosed herein, such as those set forth in Tables 54, 56 or 58 or Example XXXXIII; (b) a nucleic acid molecule that hybridizes to the nucleic acid of (a) under highly stringent hybridization conditions and comprises a nucleic acid sequence that encodes one or more variant amino acid positions disclosed herein, such as those set forth in Tables 54, 56 or 58 or Example XXXXIII; and a nucleic acid molecule that is complementary to (a) or (b). In some aspects, the isolated nucleic acid molecule can have at least 65%, 70%, 75%, 80%, 85%, 90%, 91%, 92%, 93%, 94%, 95%, 96%, 97%, 98%, or 99% sequence identity, or is identical (100% identity), to an amino acids sequence disclosed herein, such as those referenced in Tables 53, 55 or 57 or Example XXXXIII.

It is understood that a nucleic acid of the invention can exclude a wild type parental sequence, for example a parental sequence as disclosed in any of Tables 53-58. One skilled in the art will readily understand the meaning of a parental wild type sequence based on what is well known in the art. It is further understood that such a nucleic acid can exclude a naturally occurring amino acid sequence as found in nature. Thus, in a particular embodiment, the nucleic acid of the invention is as set forth above and herein, with the proviso that the encoded amino acid sequence is not the wild type parental sequence or a naturally occurring amino acid sequence and/or that the nucleic acid sequence is not a wild type or naturally occurring nucleic acid sequence. A naturally occurring amino acid or nucleic acid sequence is understood by those skilled in the art as relating to a sequence that is found in a naturally occurring organism. Thus, a nucleic acid or amino acid sequence that is not found in the same state or having the same nucleotide or encoded amino acid sequence as in a naturally occurring organism is included within the meaning of a nucleic acid and/or amino acid sequence of the invention. For example, a nucleic acid or amino acid sequence that has been altered at one or more nucleotide or amino acid positions from a parent sequence, including variants as described herein (Tables 53-58 and Example XXXXIII), are included within the meaning of a nucleic acid or amino acid sequence of the invention that is not naturally occurring. An isolated nucleic acid molecule of the invention excludes a naturally occurring chromosome that contains the nucleic acid sequence, and can further exclude other molecules as found in a naturally occurring cell such as DNA binding proteins, for example, proteins such as histones that bind to chromosomes with a eukaryotic cell.

Thus, an isolated nucleic acid sequence of the invention has physical and chemical differences compared to a naturally occurring nucleic acid sequence. An isolated or non-naturally occurring nucleic acid of the invention does not contain or does not necessarily have some or all of the chemical bonds, either covalent or non-covalent bonds, of a naturally occurring nucleic acid sequence as found in nature. An isolated nucleic acid of the invention thus differs from a naturally occurring nucleic acid, for example, by having a different chemical structure than a naturally occurring nucleic acid sequence as found in a chromosome. A different chemical structure can occur, for example, by cleavage of phosphodiester bonds that release an isolated nucleic acid sequence from a naturally occurring chromosome. An isolated nucleic acid of the invention can also differ from a naturally occurring nucleic acid by isolating or separating the nucleic acid from proteins that bind to chromosomal DNA in either prokaryotic or eukaryotic cells, thereby differing from a naturally occurring nucleic acid by different non-covalent bonds. With respect to nucleic acids of prokaryotic origin, a non-naturally occurring nucleic acid of the invention does not necessarily have some or all of the naturally occurring chemical bonds of a chromosome, for example, binding to DNA binding proteins such as polymerases or chromosome structural proteins, or is not in a higher order structure such as being supercoiled. With respect to nucleic acids of eukaryotic origin, a non-naturally occurring nucleic acid of the invention also does not contain the same internal nucleic acid chemical bonds or chemical bonds with structural proteins as found in chromatin. For example, a non-naturally occurring nucleic acid of the invention is not chemically bonded to histones or scaffold proteins and is not contained in a centromere or telomere. Thus, the non-naturally occurring nucleic acids of the invention are chemically distinct from a naturally occurring nucleic acid because they either lack or contain different van der Waals interactions, hydrogen bonds, ionic or electrostatic bonds, and/or covalent bonds from a nucleic acid as found in nature. Such differences in bonds can occur either internally within separate regions of the nucleic acid (that is cis) or such difference in bonds can occur in trans, for example, interactions with chromosomal proteins. In the case of a nucleic acid of eukaryotic origin, a cDNA is considered to be an isolated or non-naturally occurring nucleic acid since the chemical bonds within a cDNA differ from the covalent bonds, that is the sequence, of a gene on chromosomal DNA. Thus, it is understood by those skilled in the art that an isolated or non-naturally occurring nucleic acid is distinct from a naturally occurring nucleic acid.

A nucleic acid molecule encoding a 4-HB, GBL, 4-HBal, 4-HBCoA, BDO and/or putrescine pathway enzyme or protein of the invention can also include a nucleic acid molecule that hybridizes to a nucleic acid disclosed herein by SEQ ID NO, GenBank and/or GI number or a nucleic acid molecule that hybridizes to a nucleic acid molecule that encodes an amino acid sequence disclosed herein by SEQ ID NO, GenBank and/or GI number. Hybridization conditions can include highly stringent, moderately stringent, or low stringency hybridization conditions that are well known to one of skill in the art such as those described herein. Similarly, a nucleic acid molecule that can be used in the invention can be described as having a certain percent sequence identity to a nucleic acid disclosed herein by SEQ ID NO, GenBank and/or GI number or a nucleic acid molecule that hybridizes to a nucleic acid molecule that encodes an amino acid sequence disclosed herein by SEQ ID NO, GenBank and/or GI number. For example, the nucleic acid molecule can have at least 65%, 70%, 75%, 80%, 85%, 90%, 91%, 92%, 93%, 94%, 95%, 96%, 97%, 98% or 99% sequence identity, or is identical, to a nucleic acid described herein.

The phrase "stringent hybridization" is used herein to refer to conditions under which hybridized polynucleotides are stable. As known to those of skill in the art, the stability of hybridized polynucleotides is reflected in the melting temperature ($T_m$) of the hybrids. In general, the stability of a polynucleotide hybrid is a function of the salt concentration, for example, sodium ion concentration and temperature. A hybridization reaction can be performed under conditions of lower stringency, followed by washes of varying, but higher, stringency. Reference to hybridization stringency relates to such washing conditions.

The phrase "highly stringent hybridization" refers to conditions that permit hybridization of only those nucleic acid sequences that form stable hybridized polynucleotides in 0.018M NaCl at 65° C., for example, if a hybrid is not stable in 0.018M NaCl at 65° C., it will not be stable under high stringency conditions, as contemplated herein. High stringency conditions can be provided, for example, by hybridization in 50% formamide, 5×Denhart's solution, 5×SSPE, 0.2% SDS at 42° C., followed by washing in 0.1×SSPE, and 0.1% SDS at 65° C.

Hybridization conditions other than highly stringent hybridization conditions can be used to describe the nucleic acid sequences disclosed herein. For example, the phrase moderately stringent hybridization refers to conditions equivalent to hybridization in 50% formamide, 5×Denhart's solution, 5×SSPE, 0.2% SDS at 42° C., followed by washing in 0.2×SSPE, 0.2% SDS, at 42° C. The phrase low stringency hybridization refers to conditions equivalent to hybridization in 10%0 formamide, 5×Denhart's solution, 6×SSPE, 0.2% SDS at 22° C., followed by washing in 1×SSPE, 0.2% SDS, at 37° C. Denhart's solution contains 1% Ficoll, 1% polyvinylpyrolidone, and 1% bovine serum albumin (BSA). 20×SSPE (sodium chloride, sodium phosphate, ethylene diamide tetraacetic acid (EDTA)) contains 3M sodium chloride, 0.2M sodium phosphate, and 0.025 M (EDTA).

Other suitable low, moderate and high stringency hybridization buffers and conditions are well known to those of skill in the art and are described, for example, in Sambrook et al., *Molecular Cloning. A Laboratory Manual*, Cold Spring Harbor Laboratories, Cold Spring Harbor, NY, 1989; and Ausubel et al., *Current Protocols in Molecular Biology*, John Wiley and Sons, Baltimore, MD (1999)). Nucleic acids encoding polypeptides of the invention that hybridize under moderately stringent or high stringency conditions to substantially the entire sequence, or a substantial portion, for example, can be at least 15-30 nucleotides of the nucleic acid sequence set forth herein.

In certain embodiments, the isolated nucleic acid molecule of the invention encodes an amino acid sequence that includes at least two, three, four, five, six, seven, eight, nine, ten, eleven, twelve, thirteen, fourteen, fifteen, sixteen, seventeen, eighteen, nineteen, twenty or more variants in any combination disclosed herein. The variants can include any combination of those set forth in Tables 54, 56 or 58 or Example XXXXIII. The variants alone or in combination can produce an enzyme that retains or improves the activity of the wild-type (native) enzyme encoded by the nucleic acid molecule. Methods of generating and assaying such variant are well known to one of skill in the art.

In certain aspects, the invention provides a nucleic acid molecule that encodes an amino acid sequence having one or more variant disclosed herein, wherein the nucleic acid molecule has at least a certain sequence identity to a nucleotide sequence disclosed herein, for example, a nucleic acid molecule encoding a 4-HB, GBL, 4-HBal, 4-HBCoA, BDO and/or putrescine pathway enzyme or protein of the invention, can have at least a certain identity to a nucleotide sequence disclosed herein. Accordingly, in some embodiments, the invention provides a nucleic acid molecule having a nucleotide sequence of at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, or at least 99% identity, or is identical, to a nucleotide sequence disclosed herein, for example, by sequence, SEQ ID NO, GenBank and/or GI number, or a nucleic acid molecule that hybridizes to a nucleic acid molecule that encodes an amino acid sequence disclosed herein by sequence, SEQ ID NO, GenBank and/or GI number. The invention still further provides a nucleic acid molecule that encodes an amino acid sequence having one or more variant amino acid positions as disclosed herein, wherein the amino acid sequence has at least 65% identity, at least 70% identity, at least 75% identity, at least 80% identity, at least 85% identity, at least 90% identity, at least 91%, at least 92%, at least 93%, at least 94%, at least 95% identity, at least 96%, at least 97%, at least 98% identity, or at least 99% identity, or is identical, to an amino acid sequence disclosed herein. It is understood that the nucleic acids of the invention, including those with recited % identity, that encode variant polypeptides such as cat2, aldehyde dehydrogenase and alcohol dehydrogenase encode variant polypeptides that can carry out a similar enzymatic reaction as the parent polypeptide, for example, converting 4-hydroxybutyrate to 4-hydroxybutyryl-CoA, converting 4-hydroxybutyryl-CoA to 4-hydroxybutyraldehyde, or converting 4-hydroxybutyraldehyde to 1,4-butanediol, as disclosed herein (see Example XXXXII).

Accordingly, in some aspects of the invention, a nucleic acid molecule encoding a 4-HB, GBL, 4-HBal, 4-HBCoA, BDO and/or putrescine pathway enzyme or protein has a nucleotide sequence of at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, or at least 99% identity, or is identical, to a nucleic acid disclosed herein by SEQ ID NO, GenBank and/or GI number or a nucleic acid molecule that hybridizes to a nucleic acid molecule that encodes an amino acid sequence disclosed herein by SEQ ID NO, GenBank and/or GI number.

In some embodiments, the invention provides a vector containing a nucleic acid molecule disclosed herein. In some aspects, the vector can be an expression vector as disclosed herein.

In some embodiments, the invention provides a host cell containing a vector disclosed herein. In some aspects, the host cell can be a non-naturally occurring microbial organism having a pathway that produces 4-HB, GBL, 4-HBal, 4-HBCoA, BDO and/or putrescine. The nucleic acid molecule contained in the host cell can be expressed using methods well known to one of skill in the art, such as using a promoter and/or enhancer that allows expression of the nucleic acid molecule in a desired host cell. Any of a variety of inducible promoters or enhancers can also be included in the vector for regulated expression of a nucleic acid molecule.

In certain embodiments, the invention provides a host cell disclosed herein, wherein the nucleic acid molecule of the invention is integrated into the host chromosome. Integration of the nucleic acid molecule can be done using methods well known to one of skill in the art, such as those disclosed herein. For example, the methods used to integrate nucleic acids into a host chromosome described herein is not limited to the precise nucleic acid molecule integrated. It is understood that one of skill in the art would be able to apply these same methods for integration of desired nucleic acids at the same or alternative sites within the genome of a host cell. In some aspects, integration of the nucleic acid molecule of the invention can be site-specific. In some aspects, the site specific integration will be of a minimal amount of the nucleic acid molecule such as the coding region of the desired polypeptide, which can be expressed by an endogenous host promoter. Methods of site-specific integration are well known to those of skill in the art, any number of which can be used to generate the host cells of the invention. Alternatively, the nucleic acid molecule can be expressed in a cell where the nucleic acid molecule is not integrated into a host chromosome, for example, expressed in a cell from a plasmid or other vector, as disclosed herein.

In some embodiments, the host cell of the invention is a species of microorganism that is capable of fermentation. Exemplary microorganisms that are capable of fermentation are described herein. Furthermore, in some embodiments, the invention provides culture medium containing one or more host cells of the invention. In some aspect, the culture medium can be purified or substantially purified from a host cell of the invention following culturing of the host cell for production of 4-HB, GBL, 4-HBal, 4-HBCoA, BDO and/or putrescine. Methods of purifying or substantially purifying culture medium are well known to one skilled in the art and any one of which can be used to generate the culture medium of the invention, including those methods disclosed herein.

In some embodiments, the invention provides a host strain, a method of constructing a host strain, or a method of fermentation to produce 4-HB, GBL, 4-HBal, 4-HBCoA, BDO and/or putrescine with the host strain, wherein the host strain includes a deletion and/or modification that attenuates expression or activity of one or more, up to all, native host genes encoding a polypeptide (enzyme) that catalyzes the same reaction in a 4-HB, GBL, 4-HBal, 4-HBCoA, BDO and/or putrescine pathway disclosed herein. In some aspects, the host strain provides an improved yield of 4-HB, GBL, 4-HBal, 4-HBCoA, BDO and/or putrescine in the fermentation compared to the parent strain before the deletion and/or modification.

In some embodiments, the invention provides an isolated polypeptide having an amino acid sequence disclosed herein, such as those referenced in Tables 53, 55 or 57 or Example XXXXIII, wherein the amino acid sequence includes one or more variant amino acid positions as set forth in Tables 54, 56 or 58 or Example XXXXIII. In some aspects, the isolated polypeptide of the invention includes an amino acid sequence, other than the one or more variant amino acid positions as set forth in Tables 54, 56 or 58 or Example XXXXIII, with at least 65%, 70%, 75%, 80%, 85%, 90%, 91%, 92%, 93%, 94%, 95%, 96%, 97%, 98% or 99% sequence identity, or is identical, to an amino acids sequence referenced in Tables 54, 56 or 58 or Example XXXXIII. It is understood that a variant amino acid position can include any one of the 20 naturally occurring amino acids, a conservative substitution of a wild type or parental sequence at the corresponding position of the variant amino acid position, or a specific amino acid at the variant amino acid position such as those disclosed herein in Example XXXXIII. It is further understood that any of the variant amino acid positions can be combined to generate further variants. Variants with combinations of two or more variant amino acid positions exhibited activities greater than wild type (see Example XXXXIII). Thus, as exemplified herein, generating enzyme variants by combining active variant amino acid positions resulted in enzyme variants with improved properties (see Example XXXXIII). One skilled in the art can readily generate polypeptides with single variant positions or combinations of variant positions using methods well known to those skilled in the art to generate polypeptides with desired properties, including increased enzyme activity and/or stability.

"Homology" or "identity" or "similarity" refers to sequence similarity between two polypeptides or between two nucleic acid molecules. Homology can be determined by comparing a position in each sequence which may be aligned for purposes of comparison. When a position in the compared sequence is occupied by the same base or amino acid, then the molecules are homologous at that position. A degree of homology between sequences is a function of the number of matching or homologous positions shared by the sequences.

A polypeptide or polypeptide region (or a polynucleotide or polynucleotide region) has a certain percentage (for example, 65%, 70%, 75%, 80%, 85%, 90%, 95%, 98% or 99%) of "sequence identity" to another sequence means that, when aligned, that percentage of amino acids (or nucleotide bases) are the same in comparing the two sequences. Sequence identity (also known as homology or similarity) refers to sequence similarity between two nucleic acid molecules or between two polypeptides. Identity can be determined by comparing a position in each sequence, which may be aligned for purposes of comparison. When a position in the compared sequence is occupied by the same base or amino acid, then the molecules are identical at that position. A degree of identity between sequences is a function of the number of matching or homologous positions shared by the sequences. This alignment and the percent homology or sequence identity can be determined using software programs known in the art, for example those described in Ausubel et al., supra. Preferably, default parameters are used for alignment. One alignment program is BLAST, using default parameters. In particular, programs are BLASTN and BLASTP, using the following default parameters: Genetic code=standard; filter=none; strand=both; cutoff=60; expect=10; Matrix=BLOSUM62; Descriptions=50 sequences; sort by=HIGH SCORE; Databases=non-redundant, GenBank+EMBL+DDBJ+ PDB+GenBank CDS translations+SwissProtein+SPupdate+ PIR Details of these programs can be found at the National Center for Biotechnology Information (NCBI).

In certain embodiments, the invention provides an isolated polypeptide having an amino acid sequence that includes at least two, three, four, five, six, seven, eight, nine, ten, eleven, twelve, thirteen, fourteen, fifteen, sixteen, seventeen, eighteen, nineteen, twenty or more variants in any combination disclosed herein. The variants can include any combination of the variants set forth in Tables 54, 56 or 58 or Example XXXXIII. The variants alone or in combination can produce an enzyme that retains or improves the activity of the wild-type (native) enzyme encoded by the nucleic acid molecule. In some aspects, the polypeptide of the invention having any combination of variants set forth in Table 54 or Example XXXXIII (4-hydroxybutyrate coenzyme A transferase; cat 2) can convert 4-hydroxybutyrate to 4-hydroxybutyryl-CoA. In some aspects, the polypeptide of the invention having any combination of variants set forth in Table 58 or Example XXXXIII aldehyde dehydrogenase) can convert 4-hydroxybutyryl-CoA to 4-hydroxybutyraldehyde. In some aspects, the polypeptide of the invention having any combination of variants set forth in Table 56 or Example XXXXIII (alcohol dehydrogenase) can convert 4-hydroxybutyraldehyde to 1,4-butanediol. Methods of generating and assaying such polypeptides are well known to one of skill in the art.

In some embodiments, the isolated polypeptide of the invention can further include a conservative amino acid substitution in from 1 to 100 amino acid positions, or alternatively from 2 to 100 amino acid positions, or alternatively from 3 to 100 amino acid positions, or alternatively from 4 to 100 amino acid positions, or alternatively from 5 to 100 amino acid positions, or alternatively from 6 to 100 amino acid positions, or alternatively from 7 to 100 amino acid positions, or alternatively from 8 to 100 amino acid positions, or alternatively from 9 to 100 amino acid positions, or alternatively from 10 to 100 amino acid positions, or alternatively from 15 to 100 amino acid positions, or alternatively from 20 to 100 amino acid positions, or alternatively from 30 to 100 amino acid positions, or alternatively from 40 to 100 amino acid positions, or alternatively from 50 to 100 amino acid positions, or any integer therein, wherein the positions are other than the variant amino acid positions set forth in Tables 54, 56 or 58 or Example XXXXIII. In some aspects, the conservative amino acid sequence is a chemically conservative or an evolutionary conservative amino acid substitution. Methods of identifying conservative amino acids are well known to one of skill in the art, any one of which can be used to generate the isolated polypeptides of the invention.

In some embodiments, the isolated polypeptide of the invention can include no modification at from 2 to 300 amino acid positions, or alternatively 2 to 300 amino acid positions, or alternatively 3 to 300 amino acid positions, or alternatively 4 to 300 amino acid positions, or alternatively 5 to 300 amino acid positions, or alternatively 10 to 300 amino acid positions, or alternatively 20 to 300 amino acid positions, or alternatively 30 to 300 amino acid positions, or alternatively 40 to 300 amino acid positions, or alternatively 50 to 300 amino acid positions, or alternatively 60 to 300 amino acid positions, or alternatively 80 to 300 amino acid positions, or alternatively 100 to 300 amino acid positions, or alternatively 150 to 300 amino acid positions, or alternatively 200 to 300 amino acid positions, or alternatively 250 to 300 amino acid positions, or any integer therein, compared to the parent (wild-type) sequence, wherein the positions are selected from those that are identical to between 2, 3, 4, or 5 of the amino acid sequences referenced in Tables 53, 55 or 57. In a particular embodiment, a variant polypeptide of the invention that is a variant aldehyde dehydrogenase includes a variant aldehyde dehydrogenase as disclosed herein, with the proviso that the variant aldehyde dehydrogenase excludes the substitution Ile139Leu, Met204Asp, and/or Arg396Lys (numbered according to the sequence described in US 2014/0045232).

It is understood that the variant polypeptides such as polypeptide variants of cat2, aldehyde dehydrogenase and alcohol dehydrogenase can carry out a similar enzymatic reaction as the parent polypeptide, for example, converting 4-hydroxybutyrate to 4-hydroxybutyryl-CoA, converting 4-hydroxybutyryl-CoA to 4-hydroxybutyraldehyde, or converting 4-hydroxybutyraldehyde to 1,4-butanediol, as disclosed herein (see Example XXXXII). It is further understood that the polypeptide variants can include variants that provide a beneficial characteristic to the polypeptide, including but not limited to, improved catalytic activity, increased catalytic, turnover, increased substrate affinity, decreased product inhibition, and/or protein or enzyme stability. In a particular embodiment, the variants can have improved characteristics of stability while exhibiting similar activity to a wild type or parent polypeptide. In another particular embodiment, the enzyme variant can exhibit an activity that is at least the same or higher than a wild type or parent polypeptide, for example, 1.2, 1.5, 2, 2.5, 3, 3.5, 4, 4.5, 5, 5.5, 6, 6.5, 7, 7.5, 8, 8.5, 9, 9.5, 10, or even higher fold activity of the variant polypeptide over a wild type or parent polypeptide (see Example XXXXII).

The polypeptides of the invention can be isolated by a variety of methods well-known in the art, for example, recombinant expression systems, precipitation, gel filtration, ion-exchange, reverse-phase and affinity chromatography, and the like. Other well-known methods are described in Deutscher et al., *Guide to Protein Purification: Methods in Enzymology*, Vol. 182, (Academic Press, (1990)). Alternatively, the isolated polypeptides of the present invention can be obtained using well-known recombinant methods (see, for example, Sambrook et al., supra, 1989; Ausubel et al., supra, 1999). The methods and conditions for biochemical purification of a polypeptide of the invention can be chosen by those skilled in the art, and purification monitored, for example, by a functional assay.

One non-limiting example of a method for preparing the invention polypeptide is to express nucleic acids encoding the polypeptide in a suitable host cell, such as a bacterial cell, a yeast cell, or other suitable cell, using methods well known in the art, and recovering the expressed polypeptide, again using well-known purification methods, as described herein. Invention polypeptides can be isolated directly from cells that have been transformed with expression vectors as described herein. Recombinantly expressed polypeptides of the invention can also be expressed as fusion proteins with appropriate affinity tags, such as glutathione S transferase (GST), poly His, streptavidin, and the like, and affinity purified, if desired. A polypeptide of the invention can retain the affinity tag if desired, or optionally the affinity tag can be removed from the polypeptide using well known methods to remove an affinity tag for example, using appropriate enzymatic or chemical cleavage. Thus, the invention provides polypeptides of the invention without or optionally with an affinity tag. Accordingly, in some embodiments, the invention provides a host cell expressing a polypeptide of the invention disclosed herein. An invention polypeptide can also be produced by chemical synthesis using a method of polypeptide synthesis well know to one of skill in the art.

In some embodiments, the invention provides using a polypeptide disclosed herein as a biocatalyst. A "biocatalyst," as used herein, refers to a biological substance that initiates or modifies the rate of a chemical reaction. A biocatalyst can be an enzyme. A polypeptide of the invention can be used to increase the rate of conversion of a substrate to a product as disclosed herein. In the context of an industrial reaction, a polypeptide of the invention can be used, absent a host cell, to improve reactions generating 4-HB, GBL, 4-HBal, 4-HBCoA, BDO and/or putrescine, for example, using in vitro methods.

In some embodiments, the invention provides a composition having a polypeptide disclosed herein and at least one substrate for the polypeptide. Substrate for each of the polypeptides disclosed herein are described herein and are exemplified in the Figures. The polypeptide within the composition of the invention can react with a substrate under in vitro conditions. In this context, an in vitro condition refers to a reaction in the absence of or outside of a microorganism of the invention.

In some embodiments, the invention provides a method of constructing a host strain that can include, among other steps, introducing a vector disclosed herein into a host cell that is capable of fermentation. Vectors of the invention can be introduced stably or transiently into a host cell using techniques well known in the art including, but not limited to, conjugation, electroporation, chemical transformation, transduction, transfection, and ultrasound transformation. Additional methods are disclosed herein, any one of which can be used in the method of the invention.

In some embodiments, the invention provides a method for producing 4-HB, GBL, 4-HBal, 4-HBCoA, BDO and/or putrescine by culturing a host cell disclosed herein under conditions and for a sufficient period of time to produce 4-HB, GBL, 4-HBal, 4-HBCoA, BDO and/or putrescine. Exemplary culturing conditions, including various fermentation conditions, are disclosed herein, any one of which can be used in the method of the invention.

It is understood that modifications which do not substantially affect the activity of the various embodiments of this invention are also provided within the definition of the invention provided herein. Accordingly, the following examples are intended to illustrate but not limit the present invention.

Example I

Biosynthesis of 4-Hydroxybutanoic Acid

This example describes exemplary biochemical pathways for 4-HB production.

Previous reports of 4-HB synthesis in microbes have focused on this compound as an intermediate in production of the biodegradable plastic poly-hydroxyalkanoate (PHA) (U.S. Pat. No. 6,117,658). The use of 4-HB/3-HB copolymers over poly-3-hydroxybutyrate polymer (PHB) can result in plastic that is less brittle (Saito and Doi, Intl. J. Biol. Macromol. 16:99-104 (1994)). The production of monomeric 4-HB described herein is a fundamentally distinct process for several reasons: (1) the product is secreted, as opposed to PHA which is produced intracellularly and remains in the cell; (2) for organisms that produce hydroxybutanoate polymers, free 4-HB is not produced, but rather the Coenzyme A derivative is used by the polyhydroxyalkanoate synthase; (3) in the case of the polymer, formation of the granular product changes thermodynamics; and (4) extracellular pH is not an issue for production of the polymer, whereas it will affect whether 4-HB is present in the free acid or conjugate base state, and also the equilibrium between 4-HB and GBL.

4-HB can be produced in two enzymatic reduction steps from succinate, a central metabolite of the TCA cycle, with succinic semialdehyde as the intermediate (FIG. 1). The first of these enzymes, succinic semialdehyde dehydrogenase, is native to many organisms including E. coli, in which both NADH- and NADPH-dependent enzymes have been found (Donnelly and Cooper, Eur. J. Biochem. 113:555-561 (1981); Donnelly and Cooper, J. Bacteriol. 145:1425-1427 (1981); Marek and Henson, J. Bacteriol. 170:991-994 (1988)). There is also evidence supporting succinic semialdehyde dehydrogenase activity in S. cerevisiae (Ramos et al., Eur. J. Biochem. 149:401-404 (1985)), and a putative gene has been identified by sequence homology. However, most reports indicate that this enzyme proceeds in the direction of succinate synthesis, as shown in FIG. 1 (Donnelly and Cooper, supra; Lutke-Eversloh and Steinbuchel, FEMS Microbiol. Lett. 181:63-71 (1999)), participating in the degradation pathway of 4-HB and gamma-aminobutyrate. Succinic semialdehyde also is natively produced by certain microbial organisms such as E. coli through the TCA cycle intermediate α-ketogluterate via the action of two enzymes: glutamate:succinic semialdehyde transaminase and glutamate decarboxylase. An alternative pathway, used by the obligate anaerobe Clostridium kluyveri to degrade succinate, activates succinate to succinyl-CoA, then converts succinyl-CoA to succinic semialdehyde using an alternative succinic semialdehyde dehydrogenase which is known to function in this direction (Sohling and Gottschalk, Eur. J. Biochem. 212:121-127 (1993)). However, this route has the energetic cost of ATP required to convert succinate to succinyl-CoA.

The second enzyme of the pathway, 4-hydroxybutanoate dehydrogenase, is not native to E. coli or yeast but is found in various bacteria such as C. kluyveri and Ralstonia eutropha (Lutke-Eversloh and Steinbuchel, supra; Sohling and Gottschalk, *J. Bacteriol.* 178:871-880 (1996); Valentin et al., *Eur. J. Biochem.* 227:43-60 (1995); Wolff and Kenealy, *Protein Expr. Purif.* 6:206-212 (1995)). These enzymes are known to be NADH-dependent, though NADPH-dependent forms also exist. An additional pathway to 4-HB from alpha-ketoglutarate was demonstrated in *E. coli* resulting in the accumulation of poly(4-hydroxybutyric acid) (Song et al., *Wei Sheng Wu Xue. Bao.* 45:382-386 (2005)). The recombinant strain required the overexpression of three heterologous genes, PHA synthase (*R. eutropha*), 4-hydroxybutyrate dehydrogenase (*R. eutropha*) and 4-hydroxybutyrate:CoA transferase (*C. kluyveri*), along with two native *E. coli* genes: glutamate:succinic semialdehyde transaminase and glutamate decarboxylase. Steps 4 and 5 in FIG. 1 can alternatively be carried out by an alpha-ketoglutarate decarboxylase such as the one identified in *Euglena gracilis* (Shigeoka et al., *Biochem. J.* 282(Pt2):319-323 (1992); Shigeoka and Nakano, *Arch. Biochem. Biophys.* 288:22-28 (1991); Shigeoka and Nakano, *Biochem J.* 292(Pt 2):463-467 (1993)). However, this enzyme has not previously been applied to impact the production of 4-HB or related polymers in any organism.

The microbial production capabilities of 4-hydroxybutyrate were explored in two microbes, *Escherichia coli* and *Saccharomyces cerevisiae*, using in silico metabolic models of each organism. Potential pathways to 4-HB proceed via a succinate, succinyl-CoA, or alpha-ketoglutarate intermediate as shown in FIG. 1.

A first step in the 4-HB production pathway from succinate involves the conversion of succinate to succinic semialdehyde via an NADH- or NADPH-dependant succinic semialdehyde dehydrogenase. In *E. coli*, gabD is an NADP-dependant succinic semialdehyde dehydrogenase and is part of a gene cluster involved in 4-aminobutyrate uptake and degradation (Niegemann et al., *Arch. Microbiol.* 160:454-460 (1993); Schneider et al., *J. Bacteriol.* 184:6976-6986 (2002)). sad is believed to encode the enzyme for NAD-dependant succinic semialdehyde dehydrogenase activity (Marek and Henson, supra). *S. cerevisiae* contains only the NADPH-dependant succinic semialdehyde dehydrogenase, putatively assigned to UGA2, which localizes to the cytosol (Huh et al., *Nature* 425:686-691 (2003)). The maximum yield calculations assuming the succinate pathway to 4-HB in both *E. coli* and *S. cerevisiae* require only the assumption that a non-native 4-HB dehydrogenase has been added to their metabolic networks.

The pathway from succinyl-CoA to 4-hydroxybutyrate was described in U.S. Pat. No. 6,117,658 as part of a process for making polyhydroxyalkanoates comprising 4-hydroxybutyrate monomer units. *Clostridium kluyveri* is one example organism known to possess CoA-dependant succinic semialdehyde dehydrogenase activity (Sohling and Gottschalk, supra; Sohling and Gottschalk, supra). In this study, it is assumed that this enzyme, from *C. kluyveri* or another organism, is expressed in *E. coli* or *S. cerevisiae* along with a non-native or heterologous 4-HB dehydrogenase to complete the pathway from succinyl-CoA to 4-HB. The pathway from alpha-ketoglutarate to 4-HB was demonstrated in *E. coli* resulting in the accumulation of poly(4-hydroxybutyric acid) to 30% of dry cell weight (Song et al., supra). As *E. coli* and *S. cerevisiae* natively or endogenously possess both glutamate:succinic semialdehyde transaminase and glutamate decarboxylase (Coleman et al., *J. Biol. Chem.* 276:244-250 (2001)), the pathway from AKG to 4-HB can be completed in both organisms by assuming only that a non-native 4-HB dehydrogenase is present.

Example II

Biosynthesis of 1,4-Butanediol from Succinate and Alpha-ketoglutarate

This example illustrates the construction and biosynthetic production of 4-HB and BDO from microbial organisms. Pathways for 4-HB and BDO are disclosed herein.

There are several alternative enzymes that can be utilized in the pathway described above. The native or endogenous enzyme for conversion of succinate to succinyl-CoA (Step 1 in FIG. 1) can be replaced by a CoA transferase such as that encoded by the cat1 gene *C. kluyveri* (Sohling and Gottschalk, *Eur. J Biochem.* 212:121-127 (1993)), which functions in a similar manner to Step 9. However, the production of acetate by this enzyme may not be optimal, as it might be secreted rather than being converted back to acetyl-CoA. In this respect, it also can be beneficial to eliminate acetate formation in Step 9. As one alternative to this CoA transferase, a mechanism can be employed in which the 4-HB is first phosphorylated by ATP and then converted to the CoA derivative, similar to the acetate kinase/phosphotransacetylase pathway in *E. coli* for the conversion of acetate to acetyl-CoA. The net cost of this route is one ATP, which is the same as is required to regenerate acetyl-CoA from acetate. The enzymes phosphotransbutyrylase (ptb) and butyrate kinase (bk) are known to carry out these steps on the non-hydroxylated molecules for butyrate production in *C. acetobutylicum* (Cary et al., *Appl Environ Microbiol* 56:1576-1583 (1990); Valentine, R. C. and R. S. Wolfe, *J Biol Chem.* 235:1948-1952 (1960)). These enzymes are reversible, allowing synthesis to proceed in the direction of 4-HB.

BDO also can be produced via α-ketoglutarate in addition to or instead of through succinate. A described previously, and exemplified further below, one pathway to accomplish product biosynthesis is with the production of succinic semialdehyde via α-ketoglutarate using the endogenous enzymes (FIG. 1, Steps 4-5). An alternative is to use an α-ketoglutarate decarboxylase that can perform this conversion in one step (FIG. 1, Step 8; Tian et al., *Proc Natl Acad Sci USA* 102:10670-10675 (2005)).

For the construction of different strains of BDO-producing microbial organisms, a list of applicable genes was assembled for corroboration. Briefly, one or more genes within the 4-HB and/or BDO biosynthetic pathways were identified for each step of the complete BDO-producing pathway shown in FIG. 1, using available literature resources, the NCBI genetic database, and homology searches. The genes cloned and assessed in this study are presented below in in Table 6, along with the appropriate references and URL citations to the polypeptide sequence. As discussed further below, some genes were synthesized for codon optimization while others were cloned via PCR from the genomic DNA of the native or wild-type organism. For some genes both approaches were used, and in this case the native genes are indicated by an "n" suffix to the gene identification number when used in an experiment. Note that only the DNA sequences differ; the proteins are identical.

TABLE 6

Genes expressed in host BDO-producting microbial organisms.

| Gene ID number | Reaction number (FIG. 1) | Gene name | Source organism | Enzyme name | Link to protein sequence (path following www) | Reference |
|---|---|---|---|---|---|---|
| 0001 | 9 | Cat2 | Clostridium kluyveri DSM 555 | 4-hydroxybutyrate coenzyme A transferase | ncbi.nlm.nih.gov/entrez/viewer.fcgi?db=nuccore&id=1228100 | 1 |
| 0002 | 12/13 | adhE | Clostridium acetobutylicum ATCC 824 | Aldehyde/alcohol dehydrogenase | ncbi.nlm.nih.gov/entrez/viewer.fcgi?db=protein&val=15004739 | 2 |
| 0003 | 12/13 | adhE2 | Clostridium acetobutylicum ATCC 824 | Aldehyde/alcohol dehydrogenase | ncbi.nlm.nih.gov/entrez/viewer.fcgi?val=NP_149325.1 | 2 |
| 0004 | 1 | Cat1 | Clostridium kluyveri DSM 555 | Succinate coenzyme A transferase | ncbi.nlm.nih.gov/entrez/viewer.fcgi?db=nuccore&id=1228100 | 1 |
| 0008 | 6 | sucD | Clostridium kluyveri DSM 555 | Succinic semialdehyde dehydrogenase (CoA-dependent) | ncbi.nlm.nih.gov/entrez/viewer.fcgi?db=nuccore&id=1228100 | 1 |
| 0009 | 7 | 4-HBd | Ralstonia eutropha H16 | 4-hydroxybutyrate dehydrogenase (NAD-dependent) | ncbi.nlm.nih.gov/entrez/viewer.fcgi?val=YP_726053.1 | 2 |
| 0010 | 7 | 4-HBd | Clostridium kluyveri DSM 555 | 4-hydroxybutyrate dehydrogenase (NAD-dependent) | ncbi.nlm.nih.gov/entrez/viewer.fcgi?db=nuccore&id=1228100 | 1 |
| 0011 | 12/13 | adhE | E. coli | Aldehyde/alcohol dehydrogenase | shigen.nig.ac.jp/ecoli/pec/genes.List.DetailAction.do?fromListFlag=true&featureType=1&orfId=1219 | |
| 0012 | 12/13 | yqhD | E. coli | Aldehyde/alcohol dehydrogenase | shigen.nig.ac.jp/ecoli/pec/genes.List.DetailAction.do | |
| 0013 | 13 | bdhB | Clostridium acetobutylicum ATCC 824 | Butanol dehydrogenase II | ncbi.nlm.nih.gov/entrez/viewer.fcgi?val=NP_349891.1 | 2 |
| 0020 | 11 | ptb | Clostridium acetobutylicum ATCC 824 | Phosphotransbutyrylase | ncbi.nlm.nih.gov/entrez/viewer.fcgi?db=protein&id=15896327 | 2 |
| 0021 | 10 | buk1 | Clostridium acetobutylicum ATCC 824 | Butyrate kinase I | ncbi.nlm.nih.gov/entrez/viewer.fcgi?db=protein&id=20137334 | 2 |
| 0022 | 10 | buk2 | Clostridium acetobutylicum ATCC 824 | Butyrate kinase II | ncbi.nlm.nih.gov/entrez/viewer.fcgi?db=protein&id=20137415 | 2 |
| 0023 | 13 | adhEm | isolated from metalibrary of anaerobic sewage digester microbial consortia | Alcohol dehydrogenase | | (37)d} |
| 0024 | 13 | adhE | Clostridium thermocellum | Alcohol dehydrogenase | genome.jp/dbget-bin/www_bget?cth:Cthe_0423 | |
| 0025 | 13 | ald | Clostridium beijerinckii | Coenzyme A-acylating aldehyde dehydrogenase | ncbi.nlm.nih.gov/entrez/viewer.fcgi?db=protein&id=49036681 | (31)d} |
| 0026 | 13 | bdhA | Clostridium acetobutylicum ATCC 824 | Butanol dehydrogenase | ncbi.nlm.nih.gov/entrez/viewer.fcgi?val=NP_349892.1 | 2 |
| 0027 | 12 | bld | Clostridium saccharoperbutylacetonicum | Butyraldehyde dehydrogenase | ncbi.nlm.nih.gov/entrez/viewer.fcgi?db=protein&id=31075383 | 4 |
| 0028 | 13 | bdh | Clostridium saccharoperbutylacetonicum | Butanol dehydrogenase | ncbi.nlm.nih.gov/entrez/viewer.fcgi?db=protein&id=124221917 | 4 |
| 0029 | 12/13 | adhE | Clostridium tetani | Aldehyde/alcohol dehydrogenase | genome.jp/dbget-bin/www_bget?ctc:CTC01366 | |
| 0030 | 12/13 | adhE | Clostridium perfringens | Aldehyde/alcohol dehydrogenase | genome.jp/dbget-bin/www_bget?cpe:CPE2531 | |
| 0031 | 12/13 | adhE | Clostridium difficile | Aldehyde/alcohol dehydrogenase | genome.jp/dbget-bin/www_bget?cdf:CD2966 | |
| 0032 | 8 | sucA | Mycobacterium bovis BCG, Pasteur | α-ketoglutarate decarboxylase | ncbi.nlm.nih.gov/entrez/viewer.fcgi?val=YP_977400.1 | 5 |
| 0033 | 9 | cat2 | Clostridium aminobutyricum | 4-hydroxybutyrate coenzyme A transferase | ncbi.nlm.nih.gov/entrez/viewer.fcgi?db=protein&val=6249316 | |
| 0034 | 9 | cat2 | Porphyromonas gingivalis W83 | 4-hydroxybutyrate coenzyme A transferase | ncbi.nlm.nih.gov/entrez/viewer.fcgi?db=protein&val=34541558 | |
| 0035 | 6 | sucD | Porphyromonas gingivalis W83 | Succinic semialdehyde dehydrogenase (CoA-dependent) | ncbi.nlm.nih.gov/entrez/viewer.fcgi?val=NP_904963.1 | |

TABLE 6-continued

Genes expressed in host BDO-producting microbial organisms.

| Gene ID number | Reaction number (FIG. 1) | Gene name | Source organism | Enzyme name | Link to protein sequence (path following www) | Reference |
|---|---|---|---|---|---|---|
| 0036 | 7 | 4-HBd | *Porphyromonas gingivalis* W83 | NAD-dependent 4-hydroxybutyrate dehydrogenase | ncbi.nlm.nih.gov/entrez/viewer.fcgi?val=NP_904964.1 | |
| 0037 | 7 | gbd | Uncultured bacterium | 4-hydroxybutyrate dehydrogenase | ncbi.nlm.nih.gov/entrez/viewer.fcgi?db=nuccore&id=5916168 | 6 |
| 0038 | 1 | sucCD | *E. coli* | Succinyl-CoA synthetase | shigen.nig.ac.jp/ecoli/pec/genes.List.DetailAction.do | |

1 Sohling and Gottschalk, *Eur. J. Biochem.* 212: 121-127 (1993); Sohling and Gottschalk, *J. Bacteriol.* 178: 871-880 (1996)
2 Nolling et al., J., *J. Bacteriol.* 183: 4823-4838 (2001)
3 Pohlmann et al., *Nat. Biotechnol.* 24: 1257-1262 (2006)
4 Kosaka et al., *Biosci. Biotechnol. Biochem.* 71: 58-68 (2007)
5 Brosch et al., *Proc. Natl. Acad. Sci. U.S.A.* 104: 5596-5601 (2007)
6 Henne et al., *Appl. Environ. Microbiol.* 65: 3901-3907 (1999)

Expression Vector Construction for BDO pathway. Vector backbones and some strains were obtained from Dr. Rolf Lutz of Expressys (expressys.de/). The vectors and strains are based on the pZ Expression System developed by Dr. Rolf Lutz and Prof. Hermann Bujard (Lutz, R and H. Bujard, *Nucleic Acids Res* 25:1203-1210 (1997)). Vectors obtained were pZE13luc, pZA33luc, pZS*13luc and pZE22luc and contained the luciferase gene as a stuffer fragment. To replace the luciferase stuffer fragment with a lacZ-alpha fragment flanked by appropriate restriction enzyme sites, the luciferase stuffer fragment was first removed from each vector by digestion with EcoRI and XbaI. The lacZ-alpha fragment was PCR amplified from pUC19 with the following primers:

```
lacZalpha-RI
                                       (SEQ ID NO: 1)
5'GACGAATTCGCTAGCAAGAGGAGAAGTCGACATGTCCAATTCACTGG

CCGTCGTTTTAC3' lacZalpha 3'BB
                                       (SEQ ID NO: 2)
5'-GACCCTAGGAAGCTTTCTAGAGTCGACCTATGCGGCATCAGAGCA

GA-3'.
```

This generated a fragment with a 5' end of EcoRI site, NheI site, a Ribosomal Binding Site, a SalI site and the start codon. On the 3' end of the fragment contained the stop codon, XbaI, HindIII, and AvrII sites. The PCR product was digested with EcoRI and AvrII and ligated into the base vectors digested with EcoRI and XbaI (XbaI and AvrII have compatible ends and generate a non-site). Because NheI and XbaI restriction enzyme sites generate compatible ends that can be ligated together (but generate a NheI/XbaI non-site that is not digested by either enzyme), the genes cloned into the vectors could be "Biobricked" together (openwetware-.org/wiki/Synthetic_Biology:BioBricks). Briefly, this method allows joining an unlimited number of genes into the vector using the same 2 restriction sites (as long as the sites do not appear internal to the genes), because the sites between the genes are destroyed after each addition.

All vectors have the pZ designation followed by letters and numbers indication the origin of replication, antibiotic resistance marker and promoter/regulatory unit. The origin of replication is the second letter and is denoted by E for ColE1, A for p15A and S for pSC101-based origins. The first number represents the antibiotic resistance marker (1 for Ampicillin, 2 for Kanamycin, 3 for Chloramphenicol, 4 for Spectinomycin and 5 for Tetracycline). The final number defines the promoter that regulated the gene of interest (1 for $P_{LtetO-1}$, 2 for $P_{AllacO-1}$, for $P_{AllacO-1}$, and 4 for $P_{lac/ara-1}$). The MCS and the gene of interest follows immediately after. For the work discussed here we employed two base vectors, pZA33 and pZE13, modified for the biobricks insertions as discussed above. Once the gene(s) of interest have been cloned into them, resulting plasmids are indicated using the four digit gene codes given in Table 6; e.g., pZA33-XXXX-YYYY- . . . .

Host Strain Construction. The parent strain in all studies described here is *E. coli* K-12 strain MG1655. Markerless deletion strains in adhE, gabD, and aldA were constructed under service contract by a third party using the redET method (Datsenko, K. A. and B. L. Wanner, *Proc Natl Acad Sci USA* 97:6640-6645 (2000)). Subsequent strains were constructed via bacteriophage P1 mediated transduction (Miller, J. Experiments in Molecular Genetics, Cold Spring Harbor Laboratories, New York (1973)). Strain C600Z1 (lacI$^q$, PN25-tetR, Sp$^R$, lacY1, leuB6, mcrB+, supE44, thi-1, thr-1, tonA21) was obtained from Expressys and was used as a source of a lacI$^q$ allele for P1 transduction. Bacteriophage P1vir was grown on the C600Z1 *E. coli* strain, which has the spectinomycin resistance gene linked to the lacI$^q$. The P1 lysate grown on C600Z1 was used to infect MG1655 with selection for spectinomycin resistance. The spectinomycin resistant colonies were then screened for the linked lacI$^q$ by determining the ability of the transductants to repress expression of a gene linked to a $P_{AllacO}$-1 promoter. The resulting strain was designated MG1655 lacI$^q$. A similar procedure was used to introduce lacI$^Q$ into the deletion strains.

Production of 4-HB From Succinate. For construction of a 4-HB producer from succinate, genes encoding steps from succinate to 4-HB and 4-HB-CoA (1, 6, 7, and 9 in FIG. 1) were assembled onto the pZA33 and pZE13 vectors as described below. Various combinations of genes were assessed, as well as constructs bearing incomplete pathways as controls (Tables 7 and 8). The plasmids were then transformed into host strains containing lacI$^Q$, which allow inducible expression by addition of isopropyl 3-D-1-thiogalactopyranoside (IPTG). Both wild-type and hosts with deletions in genes encoding the native succinic semialdehyde dehydrogenase (step 2 in FIG. 1) were tested.

Activity of the heterologous enzymes were first tested in in vitro assays, using strain MG1655 lacI$^Q$ as the host for the plasmid constructs containing the pathway genes. Cells were grown aerobically in LB media (Difco) containing the appropriate antibiotics for each construct, and induced by addition of IPTG at 1 mM when the optical density (OD600) reached approximately 0.5. Cells were harvested after 6 hours, and enzyme assays conducted as discussed below.

In Vitro Enzyme Assays. To obtain crude extracts for activity assays, cells were harvested by centrifugation at 4,500 rpm (Beckman-Coulter, Allegera X-15R) for 10 min. The pellets were resuspended in 0.3 mL BugBuster (Novagen) reagent with benzonase and lysozyme, and lysis proceeded for 15 minutes at room temperature with gentle shaking. Cell-free lysate was obtained by centrifugation at 14,000 rpm (Eppendorf centrifuge 5402) for 30 min at 4° C. Cell protein in the sample was determined using the method of Bradford et al., Anal. Biochem. 72:248-254 (1976), and specific enzyme assays conducted as described below. Activities are reported in Units/mg protein, where a unit of activity is defined as the amount of enzyme required to convert 1 μmol of substrate in 1 min. at room temperature. In general, reported values are averages of at least 3 replicate assays.

Succinyl-CoA transferase (Cat1) activity was determined by monitoring the formation of acetyl-CoA from succinyl-CoA and acetate, following a previously described procedure Sohling and Gottschalk, J. Bacteriol. 178:871-880 (1996). Succinyl-CoA synthetase (SucCD) activity was determined by following the formation of succinyl-CoA from succinate and CoA in the presence of ATP The experiment followed a procedure described by Cha and Parks, J. Biol. Chem. 239:1961-1967 (1964). CoA-dependent succinate semialdehyde dehydrogenase (SucD) activity was determined by following the conversion of NAD to NADH at 340 nm in the presence of succinate semialdehyde and CoA (Sohling and Gottschalk, Eur. J. Biochem. 212:121-127 (1993)). 4-HB dehydrogenase (4-HBd) enzyme activity was determined by monitoring the oxidation of NADH to NAD at 340 nm in the presence of succinate semialdehyde. The experiment followed a published procedure Gerhardt et al. Arch. Microbiol. 174:189-199 (2000). 4-HB CoA transferase (Cat2) activity was determined using a modified procedure from Scherf and Buckel, Appl. Environ. Microbiol. 57:2699-2702 (1991). The formation of 4-HB-CoA or butyryl-CoA formation from acetyl-CoA and 4-HB or butyrate was determined using HPLC.

Alcohol (ADH) and aldehyde (ALD) dehydrogenase was assayed in the reductive direction using a procedure adapted from several literature sources (Durre et al., FEMS Microbiol. Rev. 17:251-262 (1995); Palosaari and Rogers, J. Bacteriol. 170:2971-2976 (1988) and Welch et al., Arch. Biochem. Biophys. 273:309-318 (1989). The oxidation of NADH is followed by reading absorbance at 340 nM every four seconds for a total of 240 seconds at room temperature. The reductive assays were performed in 100 mM MOPS (adjusted to pH 7.5 with KOH), 0.4 mM NADH, and from 1 to 50 μl of cell extract. The reaction is started by adding the following reagents: 100 μl of 100 mM acetaldehyde or butyraldehyde for ADH, or 100 μl of 1 mM acetyl-CoA or butyryl-CoA for ALD. The Spectrophotometer is quickly blanked and then the kinetic read is started. The resulting slope of the reduction in absorbance at 340 nM per minute, along with the molar extinction coefficient of NAD(P)H at 340 nM (6000) and the protein concentration of the extract, can be used to determine the specific activity.

The enzyme activity of PTB is measured in the direction of butyryl-CoA to butyryl-phosphate as described in Cary et al. J. Bacteriol. 170:4613-4618 (1988). It provides inorganic phosphate for the conversion, and follows the increase in free CoA with the reagent 5,5'-dithiobis-(2-nitrobenzoic acid), or DTNB. DTNB rapidly reacts with thiol groups such as free CoA to release the yellow-colored 2-nitro-5-mercaptobenzoic acid (TNB), which absorbs at 412 nm with a molar extinction coefficient of 14,140 M cm$^{-1}$. The assay buffer contained 150 mM potassium phosphate at pH 7.4, 0.1 mM DTNB, and 0.2 mM butyryl-CoA, and the reaction was started by addition of 2 to 50 μL cell extract. The enzyme activity of BK is measured in the direction of butyrate to butyryl-phosphate formation at the expense of ATP. The procedure is similar to the assay for acetate kinase previously described Rose et al., J. Biol. Chem. 211:737-756 (1954). However it has been found that another acetate kinase enzyme assay protocol provided by Sigma to be more useful and sensitive. This assay links conversion of ATP to ADP by acetate kinase to the linked conversion of ADP and phosphoenolpyruvate (PEP) to ATP and pyruvate by pyruvate kinase, followed by the conversion of pyruvate and NADH to lactate and NAD+ by lactate dehydrogenase. Substituting butyrate for acetate is the only major modification to allow the assay to follow BK enzyme activity. The assay mixture contained 80 mM triethanolamine buffer at pH 7.6, 200 mM sodium butyrate, 10 mM MgCl2, 0.1 mM NADH, 6.6 mM ATP, 1.8 mM phosphoenolpyruvate. Pyruvate kinase, lactate dehydrogenase, and myokinase were added according to the manufacturer's instructions. The reaction was started by adding 2 to 50 μL cell extract, and the reaction was monitored based on the decrease in absorbance at 340 nm indicating NADH oxidation.

Analysis of CoA Derivatives by HPLC. An HPLC based assay was developed to monitor enzymatic reactions involving coenzyme A (CoA) transfer. The developed method allowed enzyme activity characterization by quantitative determination of CoA, acetyl CoA (AcCoA), butyryl CoA (BuCoA) and 4-hydroxybutyrate CoA (4-HBCoA) present in in-vitro reaction mixtures. Sensitivity down to low μM was achieved, as well as excellent resolution of all the CoA derivatives of interest.

Chemical and sample preparation was performed as follows. Briefly, CoA, AcCoA, BuCoA and all other chemicals, were obtained from Sigma-Aldrich. The solvents, methanol and acetonitrile, were of HPLC grade. Standard calibration curves exhibited excellent linearity in the 0.01-1 mg/mL concentration range. Enzymatic reaction mixtures contained 100 mM Tris HCl buffer (pH 7), aliquots were taken at different time points, quenched with formic acid (0.04% final concentration) and directly analyzed by HPLC.

HPLC analysis was performed using an Agilent 1100 HPLC system equipped with a binary pump, degasser, thermostated autosampler and column compartment, and diode array detector (DAD), was used for the analysis. A reversed phase column, Kromasil 100 5 um C18, 4.6×150 mm (Peeke Scientific), was employed. 25 mM potassium phosphate (pH 7) and methanol or acetonitrile, were used as aqueous and organic solvents at 1 mL/min flow rate. Two methods were developed: a short one with a faster gradient for the analysis of well-resolved CoA, AcCoA and BuCoA, and a longer method for distinguishing between closely eluting AcCoA and 4-HBCoA. Short method employed acetonitrile gradient (0 min—5%, 6 min—30%, 6.5 min—5%, 10 min—5%) and resulted in the retention times 2.7, 4.1 and 5.5 min for CoA, AcCoA and BuCoA, respectively. In the long method methanol was used with the following linear gradient: 0 min—5%, 20 min—35%, 20.5 min—5%, 25 min—5%. The retention times for CoA, AcCoA, 4-HB-CoA and BuCoA were 5.8, 8.4, 9.2 and 16.0 min, respectively. The injection volume was 5 μL, column temperature 30° C., and UV absorbance was monitored at 260 nm.

The results demonstrated activity of each of the four pathway steps (Table 7), though activity is clearly dependent on the gene source, position of the gene in the vector, and the context of other genes with which it is expressed. For example, gene 0035 encodes a succinic semialdehyde dehydrogenase that is more active than that encoded by 0008, and 0036 and 0010n are more active 4-HB dehydrogenase genes than 0009. There also seems to be better 4-HB dehydrogenase activity when there is another gene preceding it on the same operon.

TABLE 7

In vitro enzyme activities in cell extracts from MG1655 lacI$^Q$ containing the plasmids expressing genes in the 4-HB-CoA pathway. Activities are reported in Units/mg protein, where a unit of activity is defined as the amount of enzyme required to convert 1 μmol of substrate in 1 min. at room temperature.

| Sample # | pZE13 (a) | pZA33 (b) | OD600 | Cell Prot (c) | Cat1 | SucD | 4HBd | Cat2 |
|---|---|---|---|---|---|---|---|---|
| 1 | cat1 (0004) | | 2.71 | 6.43 | 1.232 | 0.00 | | |
| 2 | cat1 (0004)-sucD (0035) | | 2.03 | 5.00 | 0.761 | 2.57 | | |
| 3 | cat1 (0004)-sucD (0008) | | 1.04 | 3.01 | 0.783 | 0.01 | | |
| 4 | sucD (0035) | | 2.31 | 6.94 | | 2.32 | | |
| 5 | sucD (0008) | | 1.10 | 4.16 | | 0.05 | | |
| 6 | | 4hbd (0009) | 2.81 | 7.94 | 0.003 | | 0.25 | |
| 7 | | 4hbd (0036) | 2.63 | 7.84 | | | 3.31 | |
| 8 | | 4hbd (0010n) | 2.00 | 5.08 | | | 2.57 | |
| 9 | cat1 (0004)-sucD (0035) | 4hbd (0009) | 2.07 | 5.04 | 0.600 | 1.85 | 0.01 | |
| 10 | cat1 (0004)-sucD (0035) | 4hbd (0036) | 2.08 | 5.40 | 0.694 | 1.73 | 0.41 | |
| 11 | cat1 (0004)-sucD (0035) | 4hbd (0010n) | 2.44 | 4.73 | 0.679 | 2.28 | 0.37 | |
| 12 | cat1 (0004)-sucD (0008) | 4hbd (0009) | 1.08 | 3.99 | 0.572 | −0.01 | 0.02 | |
| 13 | cat1 (0004)-sucD (0008) | 4hbd (0036) | 0.77 | 2.60 | 0.898 | −0.01 | 0.04 | |
| 14 | cat1 (0004)-sucD (0008) | 4hbd (0010n) | 0.63 | 2.47 | 0.776 | 0.00 | 0.00 | |
| 15 | | cat2 (0034) | 2.56 | 7.86 | | | | 1.283 |
| 16 | | cat2(0034)-4hbd(0036) | 3.13 | 8.04 | | | 24.86 | 0.993 |
| 17 | | cat2(0034)-4hbd(0010n) | 2.38 | 7.03 | | | 7.45 | 0.675 |
| 18 | | 4hbd(0036)-cat2(0034) | 2.69 | 8.26 | | | 2.15 | 7.490 |
| 19 | | 4hbd(0010n)-cat2(0034) | 2.44 | 6.59 | | | 0.59 | 4.101 |

Genes expressed from Plac on pZE13, a high-copy plasmid with colE1 origin and ampicillin resistance. Gene identification numbers are as given in Table 6
Genes expressed from Plac on pZA33, a medium-copy plasmid with pACYC origin and chloramphenicol resistance.
(c) Cell protein given as mg protein per mL extract.

Recombinant strains containing genes in the 4-HB pathway were then evaluated for the ability to produce 4-HB in vivo from central metabolic intermediates. Cells were grown anaerobically in LB medium to OD600 of approximately 0.4, then induced with 1 mM IPTG One hour later, sodium succinate was added to 10 mM, and samples taken for analysis following an additional 24 and 48 hours. 4-HB in the culture broth was analyzed by GC-MS as described below. The results indicate that the recombinant strain can produce over 2 mM 4-HB after 24 hours, compared to essentially zero in the control strain (Table 8).

TABLE 8

Production of 4-HB from succinate in *E. coli* strains harboring plasmids expressing various combinations of 4-HB pathway genes.

| | | | | 24 Hours | | | 48 Hours | | |
|---|---|---|---|---|---|---|---|---|---|
| Sample # | Host Strain | pZE13 | pZA33 | OD600 | 4HB, μM | 4HB norm. (a) | OD600 | 4HB, μM | 4HB norm. (a) |
| 1 | MG1655 lacIq | cat1 (0004)-sucD (0035) | 4hbd (0009) | 0.47 | 487 | 1036 | 1.04 | 1780 | 1711 |
| 2 | MG1655 lacIq | cat1 (0004)-sucD (0035) | 4hbd (0027) | 0.41 | 111 | 270 | 0.99 | 214 | 217 |
| 3 | MG1655 lacIq | cat1 (0004)-sucD (0035) | 4hbd (0036) | 0.47 | 863 | 1835 | 0.48 | 2152 | 4484 |
| 4 | MG1655 lacIq | cat1 (0004)-sucD (0035) | 4hbd (0010n) | 0.46 | 956 | 2078 | 0.49 | 2221 | 4533 |
| 5 | MG1655 lacIq | cat1 (0004)-sucD (0008) | 4hbd (0009) | 0.38 | 493 | 1296 | 0.37 | 1338 | 3616 |
| 6 | MG1655 lacIq | cat1 (0004)-sucD (0008) | 4hbd (0027) | 0.32 | 26 | 81 | 0.27 | 87 | 323 |
| 7 | MG1655 lacIq | cat1 (0004)-sucD (0008) | 4hbd (0036) | 0.24 | 506 | 2108 | 0.31 | 1448 | 4672 |
| 8 | MG1655 lacIq | cat1 (0004)-sucD (0008) | 4hbd (0010n) | 0.24 | 78 | 324 | 0.56 | 233 | 416 |
| 9 | MG1655 lacIq gabD | cat1 (0004)-sucD (0035) | 4hbd (0009) | 0.53 | 656 | 1237 | 1.03 | 1643 | 1595 |
| 10 | MG1655 lacIq gabD | cat1 (0004)-sucD (0035) | 4hbd (0027) | 0.44 | 92 | 209 | 0.98 | 214 | 218 |
| 11 | MG1655 lacIq gabD | cat1 (0004)-sucD (0035) | 4hbd (0036) | 0.51 | 1072 | 2102 | 0.97 | 2358 | 2431 |
| 12 | MG1655 lacIq gabD | cat1 (0004)-sucD (0035) | 4hbd (0010n) | 0.51 | 981 | 1924 | 0.97 | 2121 | 2186 |
| 13 | MG1655 lacIq gabD | cat1 (0004)-sucD (0008) | 4hbd (0009) | 0.35 | 407 | 1162 | 0.77 | 1178 | 1530 |
| 14 | MG1655 lacIq gabD | cat1 (0004)-sucD (0008) | 4hbd (0027) | 0.51 | 19 | 36 | 1.07 | 50 | 47 |

TABLE 8-continued

Production of 4-HB from succinate in *E. coli* strains harboring plasmids expressing various combinations of 4-HB pathway genes.

| | | | | 24 Hours | | | 48 Hours | | |
|---|---|---|---|---|---|---|---|---|---|
| Sample # | Host Strain | pZE13 | pZA33 | OD600 | 4HB, µM | 4HB norm. (a) | OD600 | 4HB, µM | 4HB norm. (a) |
| 15 | MG1655 lacIq gabD | cat1 (0004)-sucD (0008) | 4hbd (0036) | 0.35 | 584 | 1669 | 0.78 | 1350 | 1731 |
| 16 | MG1655 lacIq gabD | cat1 (0004)-sucD (0008) | 4hbd (0010n) | 0.32 | 74 | 232 | 0.82 | 232 | 283 |
| 17 | MG1655 lacIq | vector only | vector only | 0.8 | 1 | 2 | 1.44 | 3 | 2 |
| 18 | MG1655 lacIq gabD | vector only | vector only | 0.89 | 1 | 2 | 1.41 | 7 | 5 |

(a) Normalized 4-HB concentration, µM/OD600 units

An alternate to using a CoA transferase (cat1) to produce succinyl-CoA from succinate is to use the native *E. coli* sucCD genes, encoding succinyl-CoA synthetase. This gene cluster was cloned onto pZE13 along with candidate genes for the remaining steps to 4-HB to create pZE13-0038-0035-0036.

Figure 3A:
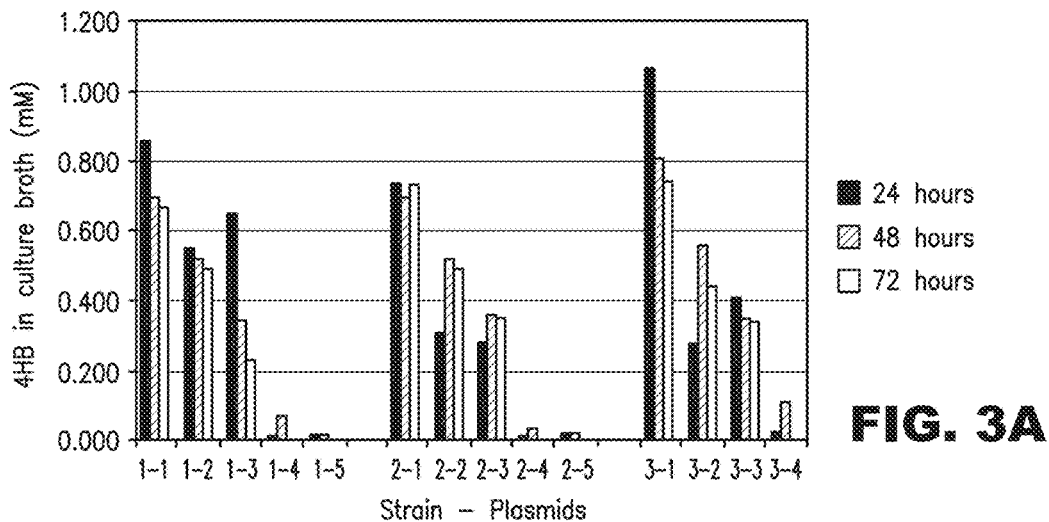
FIGS. 3A-3C show the production of 4-HB in glucose minimal medium using *E. coli* strains harboring plasmids expressing various combinations of 4-HB pathway genes.
Figure 3B:
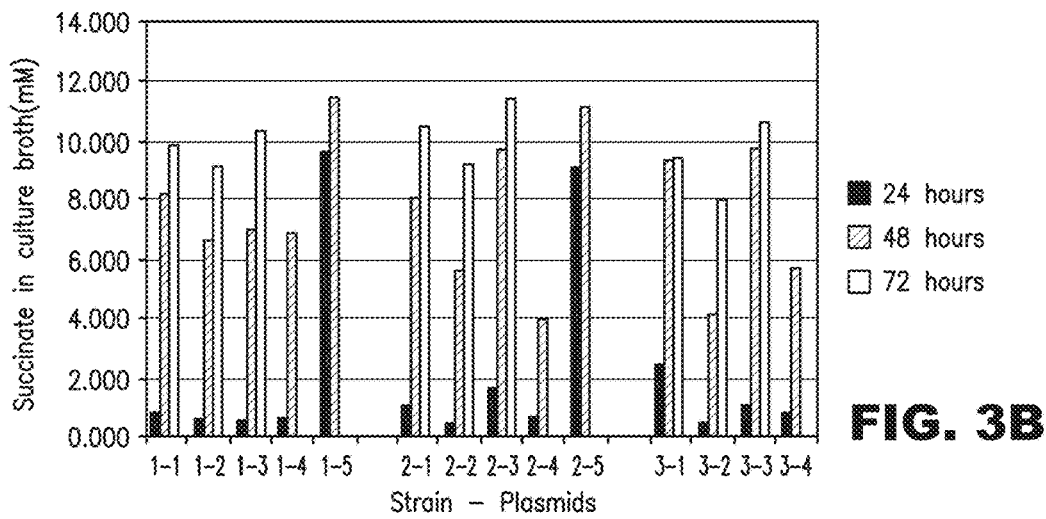
Figure 3C:
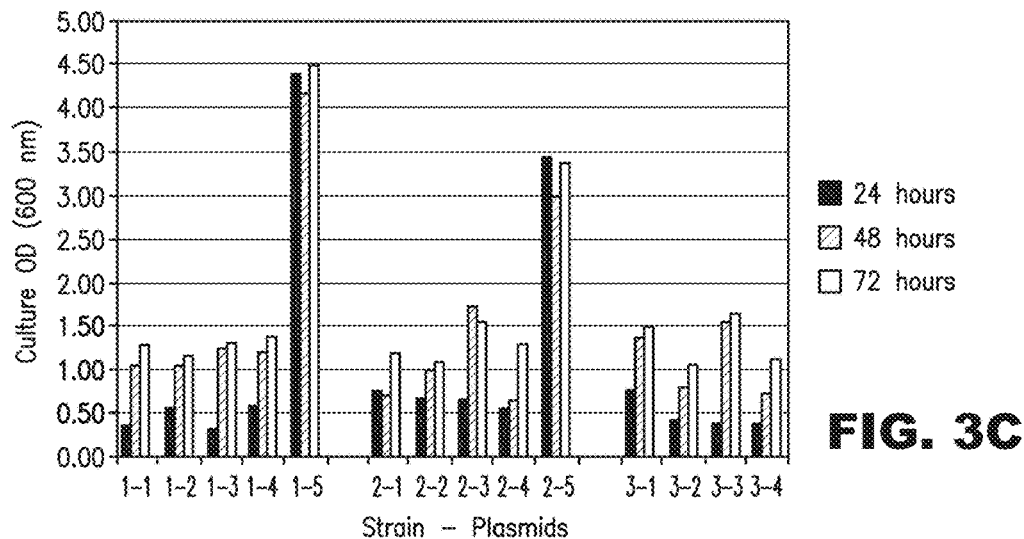

Production of 4-HB from Glucose. Although the above experiments demonstrate a functional pathway to 4-HB from a central metabolic intermediate (succinate), an industrial process would require the production of chemicals from low-cost carbohydrate feedstocks such as glucose or sucrose. Thus, the next set of experiments was aimed to determine whether endogenous succinate produced by the cells during growth on glucose could fuel the 4-HB pathway. Cells were grown anaerobically in M9 minimal medium (6.78 g/L $Na_2HPO_4$, 3.0 g/L $KH_2PO_4$, 0.5 g/L NaCl, 1.0 g/L $NH_4Cl$, 1 mM $MgSO_4$, 0.1 mM $CaCl_2$) supplemented with 20 g/L glucose, 100 mM 3-(N-morpholino)propanesulfonic acid (MOPS) to improve the buffering capacity, 10 µg/mL thiamine, and the appropriate antibiotics. 0.25 mM IPTG was added when OD600 reached approximately 0.2, and samples taken for 4-HB analysis every 24 hours following induction. In all cases 4-HB plateaued after 24 hours, with a maximum of about 1 mM in the best strains (FIG. 3a), while the succinate concentration continued to rise (FIG. 3b). This indicates that the supply of succinate to the pathway is likely not limiting, and that the bottleneck may be in the activity of the enzymes themselves or in NADH availability. 0035 and 0036 are clearly the best gene candidates for CoA-dependent succinic semialdehyde dehydrogenase and 4-HB dehydrogenase, respectively. The elimination of one or both of the genes encoding known (gabD) or putative (aldA) native succinic semialdehyde dehydrogenases had little effect on performance. Finally, it should be noted that the cells grew to a much lower OD in the 4-HB-producing strains than in the controls (FIG. 3c).

Figure 4:
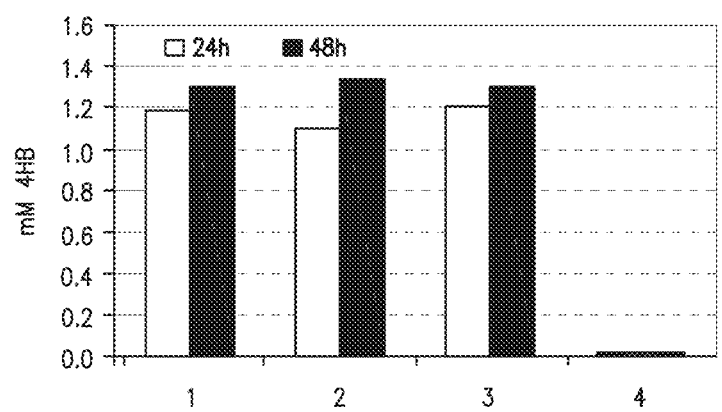
FIG. 4 shows the production of 4-HB from glucose in *E. coli* strains expressing α-ketoglutarate decarboxylase from *Mycobacterium tuberculosis*. Strains 1-3 contain pZE13-0032 and pZA33-0036. Strain 4 expresses only the empty vectors pZE13 and pZA33. Host strains are as follows: 1 and 4, MG1655 lacI$^Q$; 2, MG1655 ΔgabD lacI$^Q$; 3, MG1655 ΔgabD ΔaldAlacI$^Q$. The bars refer to concentration at 24 and 48 hours.

An alternate pathway for the production of 4-HB from glucose is via α-ketoglutarate. We explored the use of an α-ketoglutarate decarboxylase from *Mycobacterium tuberculosis* Tian et al., *Proc. Natl. Acad Sci. USA* 102:10670-10675 (2005) to produce succinic semialdehyde directly from α-ketoglutarate (step 8 in FIG. 1). To demonstrate that this gene (0032) was functional in vivo, we expressed it on pZE13 in the same host as 4-HB dehydrogenase (gene 0036) on pZA33. This strain was capable of producing over 1.0 mM 4-HB within 24 hours following induction with 1 mM IPTG (FIG. 4). Since this strain does not express a CoA-dependent succinic semialdehyde dehydrogenase, the possibility of succinic semialdehyde production via succinyl-CoA is eliminated. It is also possible that the native genes responsible for producing succinic semialdehyde could function in this pathway (steps 4 and 5 in FIG. 1); however, the amount of 4-HB produced when the pZE13-0032 plasmid was left out of the host is the negligible.

Production of BDO from 4-HB. The production of BDO from 4-HB required two reduction steps, catalyzed by dehydrogenases. Alcohol and aldehyde dehydrogenases (ADH and ALD, respectively) are NAD+/H and/or NADP+/H-dependent enzymes that together can reduce a carboxylic acid group on a molecule to an alcohol group, or in reverse, can perform the oxidation of an alcohol to a carboxylic acid. This biotransformation has been demonstrated in wild-type *Clostridium acetobutylicum* (Jewell et al., *Current Microbiology*, 13:215-19 (1986)), but neither the enzymes responsible nor the genes responsible were identified. In addition, it is not known whether activation to 4-HB-CoA is first required (step 9 in FIG. 1), or if the aldehyde dehydrogenase (step 12) can act directly on 4-HB. We developed a list of candidate enzymes from *C. acetobutylicum* and related organisms based on known activity with the non-hydroxylated analogues to 4-HB and pathway intermediates, or by similarity to these characterized genes (Table 6). Since some of the candidates are multifunctional dehydrogenases, they could potentially catalyze both the NAD(P)H-dependent reduction of the acid (or CoA-derivative) to the aldehyde, and of the aldehyde to the alcohol. Before beginning work with these genes in *E. coli*, we first validated the result referenced above using *C. acetobutylicum* ATCC 824. Cells were grown in Schaedler broth (Accumedia, Lansing, MI) supplemented with 10 mM 4-HB, in an anaerobic atmosphere of 10% $CO_2$, 10% $H_2$, and 80% $N_2$ at 30° C. Periodic culture samples were taken, centrifuged, and the broth analyzed for BDO by GC-MS as described below. BDO concentrations of 0.1 mM, 0.9 mM, and 1.5 mM were detected after 1 day, 2 days, and 7 days incubation, respectively. No BDO was detected in culture grown without 4-HB addition. To demonstrate that the BDO produced was derived from glucose, we grew the best BDO producing strain MG1655 lacI$^Q$ pZE13-0004-0035-0002 pZA33-0034-0036 in M9 minimal medium supplemented with 4 g/L uniformly labeled $^{13}$C-glucose. Cells were induced at OD of 0.67 with 1 mM IPTG, and a sample taken after 24 hours. Analysis of the culture supernatant was performed by mass spectrometry.

Gene candidates for the 4-HB to BDO conversion pathway were next tested for activity when expressed in the *E. coli* host MG1655 lacI$^Q$. Recombinant strains containing each gene candidate expressed on pZA33 were grown in the presence of 0.25 mM IPTG for four hours at 37° C. to fully induce expression of the enzyme. Four hours after induction, cells were harvested and assayed for ADH and ALD activity as described above. Since 4-HB-CoA and 4-hydroxybutyraldehyde are not available commercially, assays were performed using the non-hydroxylated substrates (Table 9). The ratio in activity between 4-carbon and 2-carbon substrates for C. acetobutylicum adhE2 (0002) and E. coli adhE (0011) were similar to those previously reported in the literature a Atsumi et al., Biochim. Biophys. Acta. 1207:1-11 (1994).

TABLE 9

In vitro enzyme activities in cell extracts from MG1655 lacI$^Q$ containing pZA33 expressing gene candidates for aldehyde and alcohol dehydrogenases. Activities are expressed in μmol min$^{-1}$ mg cell protein$^{-1}$.

| Gene | Substrate | Aldehyde dehydrogenase | | Alcohol dehydrogenase | |
|---|---|---|---|---|---|
| | | Butyryl-CoA | Acetyl-CoA | Butyraldehyde | Acetaldehyde |
| 0002 | | 0.0076 | 0.0046 | 0.0264 | 0.0247 |
| 0003n | | 0.0060 | 0.0072 | 0.0080 | 0.0075 |
| 0011 | | 0.0069 | 0.0095 | 0.0265 | 0.0093 |
| 0013 | | N.D. | N.D. | 0.0130 | 0.0142 |
| 0023 | | 0.0089 | 0.0137 | 0.0178 | 0.0235 |
| 0025 | | 0 | 0.0001 | N.D. | N.D. |
| 0026 | | 0 | 0.0005 | 0.0024 | 0.0008 |

N.D., not determined.

Figure 5:
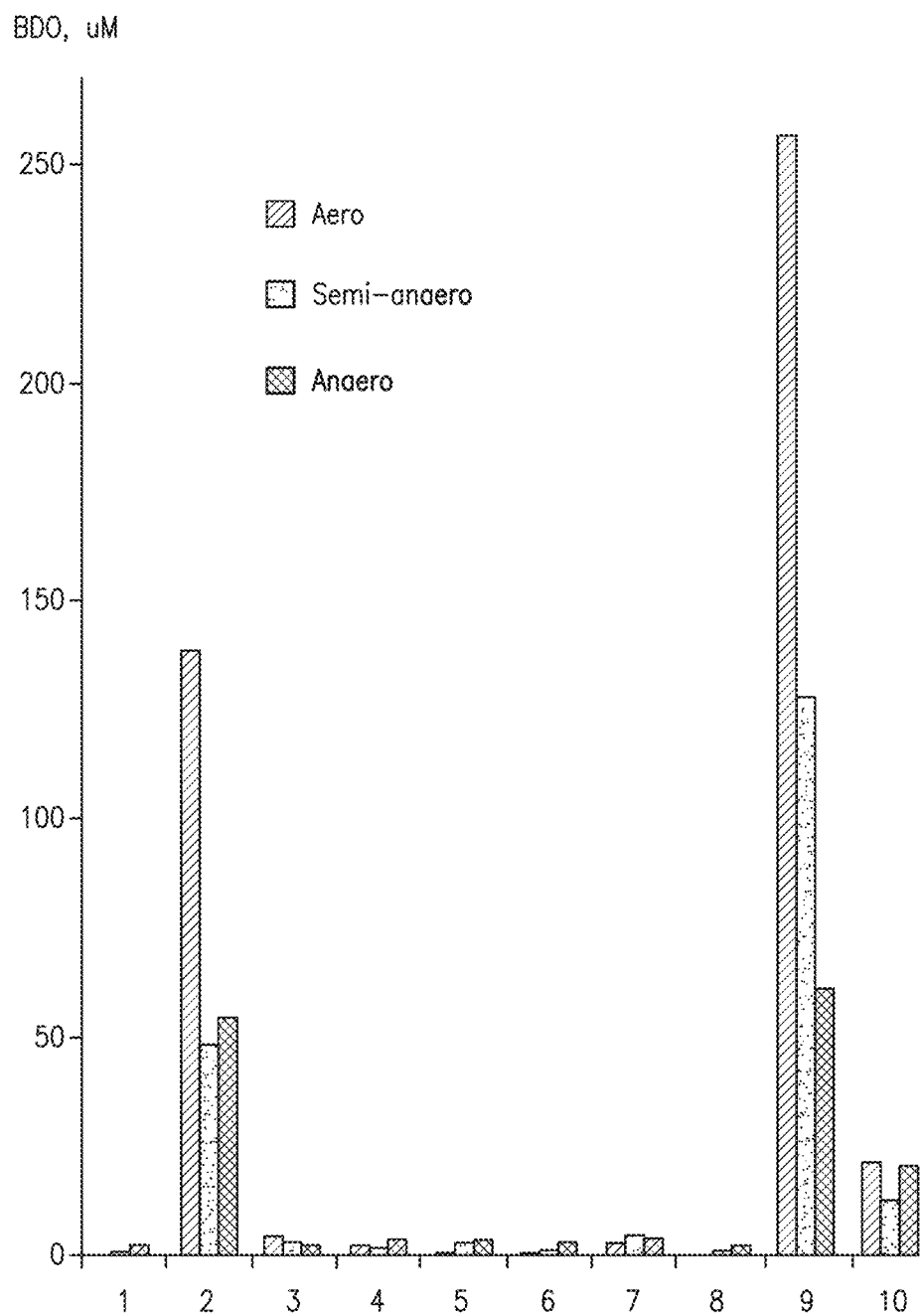
FIG. 5 shows the production of BDO from 10 mM 4-HB in recombinant *E. coli* strains. Numbered positions correspond to experiments with MG1655 lacI$^Q$ containing pZA33-0024, expressing cat2 from *P. gingivalis*, and the following genes expressed on pZE13: 1, none (control); 2, 0002; 3, 0003; 4, 0003n; 5, 0011; 6, 0013; 7, 0023; 8, 0025; 9, 0008n; 10, 0035. Gene numbers are defined in Table 6. For each position, the bars refer to aerobic, microaerobic, and anaerobic conditions, respectively. Microaerobic conditions were created by sealing the culture tubes but not evacuating them.
Figure 6A:
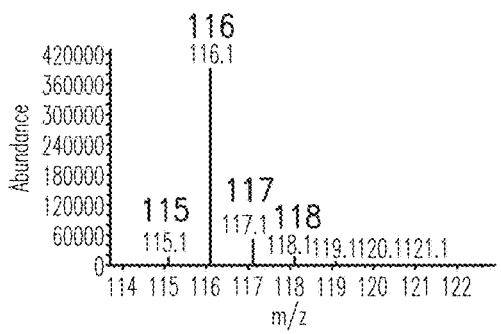
FIGS. 6A-6H show the mass spectrum of 4-HB and BDO produced by MG1655 lacI$^Q$ pZE13-0004-0035-0002 pZA33-0034-0036 grown in M9 minimal medium supplemented with 4 g/L unlabeled glucose (FIGS. 6A, 6C, 6E and 6G) uniformly labeled $^{13}$C-glucose (FIGS. 6B, 6D, 6F and 6H).
Figure 6B:
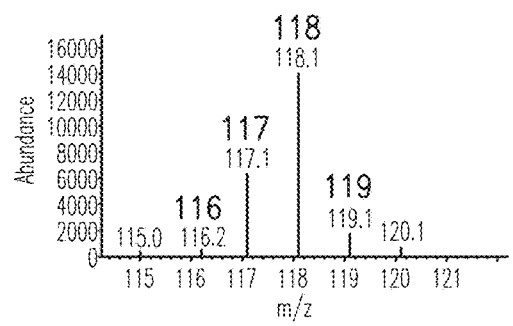
Figure 6C:
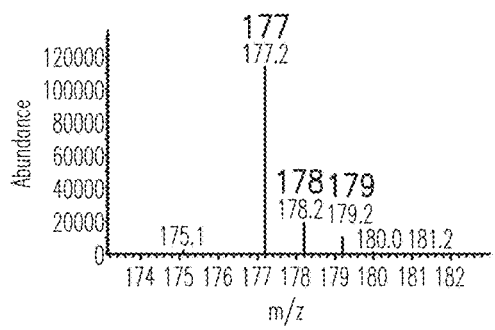
Figure 6D:
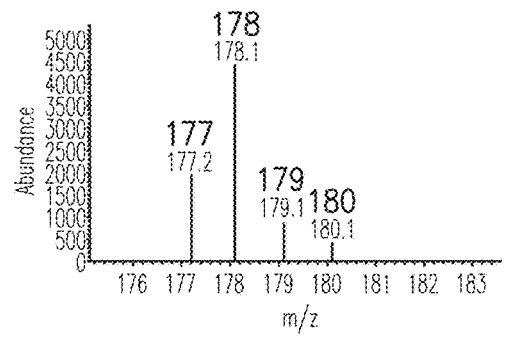
Figure 6E:
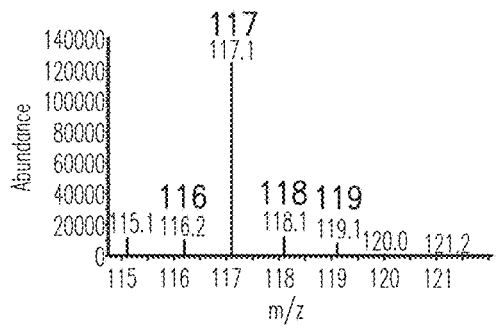
Figure 6F:
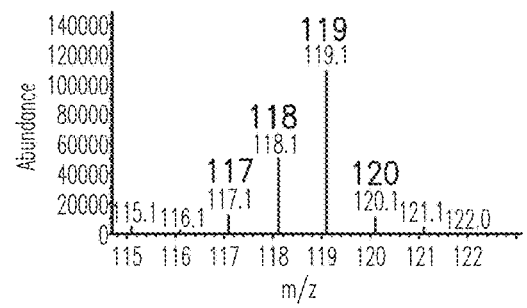
Figure 6G:
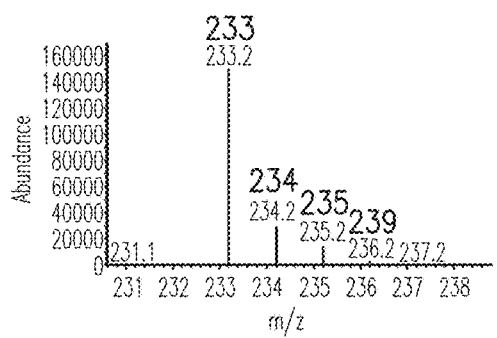
Figure 6H:
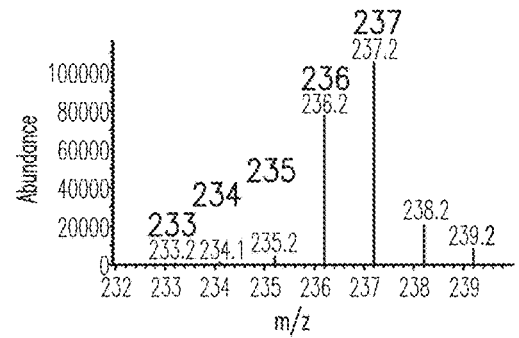
Figure 7:
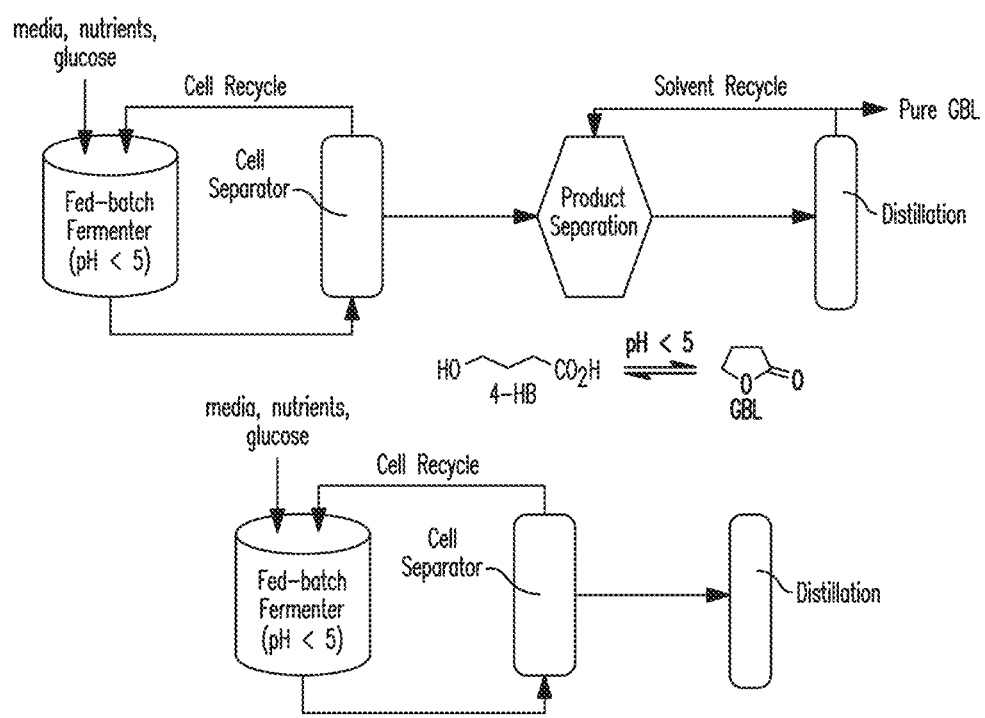
FIG. 7 is a schematic process flow diagram of bioprocesses for the production of γ-butyrolactone. Upper panel illustrates fed-batch fermentation with batch separation and lower panel illustrates fed-batch fermentation with continuous separation.

For the BDO production experiments, cat2 from *Porphyromonas gingivalis* W83 (gene 0034) was included on pZA33 for the conversion of 4-HB to 4-HB-CoA, while the candidate dehydrogenase genes were expressed on pZE13. The host strain was MG1655 lacI$^Q$. Along with the alcohol and aldehyde dehydrogenase candidates, we also tested the ability of CoA-dependent succinic semialdehyde dehydrogenases (sucD) to function in this step, due to the similarity of the substrates. Cells were grown to an OD of about 0.5 in LB medium supplemented with 10 mM 4-HB, induced with 1 mM IPTG, and culture broth samples taken after 24 hours and analyzed for BDO as described below. The best BDO production occurred using adhE2 from *C. acetobutylicum*, sucD from *C. kluyveri*, or sucD from *P. gingivalis* (FIG. 5). Interestingly, the absolute amount of BDO produced was higher under aerobic conditions; however, this is primarily due to the lower cell density achieved in anaerobic cultures. When normalized to cell OD, the BDO production per unit biomass is higher in anaerobic conditions (Table 10).

TABLE 10

Absolute and normalized BDO concentrations from cultures of cells expressing adhE2 from *C. acetobutylicum*, sucD from *C. kluyveri*, or sucD from *P. gingivalis* (data from experiments 2, 9, and 10 in FIG. 3), as well as the negative control (experiment 1).

| Gene expressed | Conditions | BDO (μM) | OD (600 nm) | BDO/OD |
|---|---|---|---|---|
| none | Aerobic | 0 | 13.4 | 0 |
| none | Microaerobic | 0.5 | 6.7 | 0.09 |
| none | Anaerobic | 2.2 | 1.26 | 1.75 |
| 0002 | Aerobic | 138.3 | 9.12 | 15.2 |
| 0002 | Microaerobic | 48.2 | 5.52 | 8.73 |
| 0002 | Anaerobic | 54.7 | 1.35 | 40.5 |
| 0008n | Aerobic | 255.8 | 5.37 | 47.6 |
| 0008n | Microaerobic | 127.9 | 3.05 | 41.9 |
| 0008n | Anaerobic | 60.8 | 0.62 | 98.1 |
| 0035 | Aerobic | 21.3 | 14.0 | 1.52 |
| 0035 | Microaerobic | 13.1 | 4.14 | 3.16 |
| 0035 | Anaerobic | 21.3 | 1.06 | 20.1 |

As discussed above, it may be advantageous to use a route for converting 4-HB to 4-HB-CoA that does not generate acetate as a byproduct. To this aim, we tested the use of phosphotransbutyrylase (ptb) and butyrate kinase (bk) from *C. acetobutylicum* to carry out this conversion via steps 10 and 11 in FIG. 1. The native ptb/bk operon from *C. acetobutylicum* (genes 0020 and 0021) was cloned and expressed in pZA33. Extracts from cells containing the resulting construct were taken and assayed for the two enzyme activities as described herein. The specific activity of BK was approximately 65 U/mg, while the specific activity of PTB was approximately 5 U/mg. One unit (U) of activity is defined as conversion of 1 M substrate in 1 minute at room temperature. Finally, the construct was tested for participation in the conversion of 4-HB to BDO. Host strains were transformed with the pZA33-0020-0021 construct described and pZE13-0002, and compared to use of cat2 in BDO production using the aerobic procedure used above in FIG. 5. The BK/PTB strain produced 1 mM BDO, compared to 2 mM when using cat2 (Table 11). Interestingly, the results were dependent on whether the host strain contained a deletion in the native adhE gene.

TABLE 11

Absolute and normalized BDO concentrations from cultures of cells expressing adhE2 from *C. acetobutylicum* in pZE13 along with either cat2 from *P. gingivalis* (0034) or the PTB/BK genes from *C. acetobutylicum* on pZA33. Host strains were either MG1655 lacI$^Q$ or MG1655 ΔadhE lacI$^Q$.

| Genes | Host Strain | BDO (μM) | OD (600 nm) | BDO/OD |
|---|---|---|---|---|
| 0034 | MG1655 lacI$^Q$ | 0.827 | 19.9 | 0.042 |
| 0020 + 0021 | MG1655 lacI$^Q$ | 0.007 | 9.8 | 0.0007 |
| 0034 | MG1655 ΔadhE lacI$^Q$ | 2.084 | 12.5 | 0.166 |
| 0020 + 0021 | MG1655 ΔadhE lacI$^Q$ | 0.975 | 18.8 | 0.052 |

Production of BDO from Glucose. The final step of pathway corroboration is to express both the 4-HB and BDO segments of the pathway in *E. coli* and demonstrate production of BDO in glucose minimal medium. New plasmids were constructed so that all the required genes fit on two plamids. In general, cat1, adhE, and sucD genes were expressed from pZE13, and cat2 and 4-HBd were expressed from pZA33. Various combinations of gene source and gene order were tested in the MG1655 lacI$^Q$ background. Cells were grown anaerobically in M9 minimal medium (6.78 g/L Na$_2$HPO$_4$, 3.0 g/L KH$_2$PO$_4$, 0.5 g/L NaCl, 1.0 g/L NH$_4$Cl, 1 mM MgSO$_4$, 0.1 mM CaCl$_2$) supplemented with 20 g/L glucose, 100 mM 3-(N-morpholino)propanesulfonic acid (MOPS) to improve the buffering capacity, 10 μg/mL thiamine, and the appropriate antibiotics. 0.25 mM IPTG was added approximately 15 hours following inoculation, and culture supernatant samples taken for BDO, 4-HB, and succinate analysis 24 and 48 hours following induction. The production of BDO appeared to show a dependency on gene order (Table 12). The highest BDO production, over 0.5 mM, was obtained with cat2 expressed first, followed by 4-HBd on pZA33, and cat1 followed by *P. gingivalis* sucD on pZE13. The addition of *C. acetobutylicum* adhE2 in the last position on pZE13 resulted in slight improvement. 4-HB and succinate were also produced at higher concentrations.

TABLE 12

Production of BDO, 4-HB, and succinate in recombinant *E. coli* strains expressing combinations of BDO pathway genes, grown in minimal medium supplemented with 20 g/L glucose. Concentrations are given in mM.

| | | | | 24 Hours | | | | 48 Hours | | | |
|---|---|---|---|---|---|---|---|---|---|---|---|
| Sample | pZE13 | pZA33 | Induction OD | OD600 nm | Su | 4HB | BDO | OD600 nm | Su | 4HB | BDO |
| 1 | cat1(0004)-sucD(0035) | 4hbd (0036)-cat2(0034) | 0.92 | 1.29 | 5.44 | 1.37 | 0.240 | 1.24 | 6.42 | 1.49 | 0.280 |
| 2 | cat1(0004)-sucD(0008N) | 4hbd (0036)-cat2(0034) | 0.36 | 1.11 | 6.90 | 1.24 | 0.011 | 1.06 | 7.63 | 1.33 | 0.011 |
| 3 | adhE(0002)-cat1(0004)-sucD(0035) | 4hbd (0036)-cat2(0034) | 0.20 | 0.44 | 0.34 | 1.84 | 0.050 | 0.60 | 1.93 | 2.67 | 0.119 |
| 4 | cat1(0004)-sucD(0035)-adhE(0002) | 4hbd (0036)-cat2(0034) | 1.31 | 1.90 | 9.02 | 0.73 | 0.073 | 1.95 | 9.73 | 0.82 | 0.077 |
| 5 | adhE(0002)-cat1(0004)-sucD(0008N) | 4hbd (0036)-cat2(0034) | 0.17 | 0.45 | 1.04 | 1.04 | 0.008 | 0.94 | 7.13 | 1.02 | 0.017 |
| 6 | cat1(0004)-sucD(0008N)-adhE(0002) | 4hbd (0036)-cat2(0034) | 1.30 | 1.77 | 10.47 | 0.25 | 0.004 | 1.80 | 11.49 | 0.28 | 0.003 |
| 7 | cat1(0004)-sucD(0035) | cat2(0034)-4hbd(0036) | 1.09 | 1.29 | 5.63 | 2.15 | 0.461 | 1.38 | 6.66 | 2.30 | 0.520 |
| 8 | cat1(0004)-sucD(0008N) | cat2(0034)-4hbd(0036) | 1.81 | 2.01 | 11.28 | 0.02 | 0.000 | 2.24 | 11.13 | 0.02 | 0.000 |
| 9 | adhE(0002)-cat1(0004)-sucD(0035) | cat2(0034)-4hbd(0036) | 0.24 | 1.99 | 2.02 | 2.32 | 0.106 | 0.89 | 4.85 | 2.41 | 0.186 |
| 10 | cat1(0004)-sucD(0035)-adhE(0002) | cat2(0034)-4hbd(0036) | 0.98 | 1.17 | 5.30 | 2.08 | 0.569 | 1.33 | 6.15 | 2.14 | 0.640 |
| 11 | adhE(0002)-cat1(0004)-sucD(0008N) | cat2(0034)-4hbd(0036) | 0.20 | 0.53 | 1.38 | 2.30 | 0.019 | 0.91 | 8.10 | 1.49 | 0.034 |
| 12 | cat1(0004)-sucD(0008N)-adhE(0002) | cat2(0034)-4hbd(0036) | 2.14 | 2.73 | 12.07 | 0.16 | 0.000 | 3.10 | 11.79 | 0.17 | 0.002 |
| 13 | vector only | vector only | 2.11 | 2.62 | 9.03 | 0.01 | 0.000 | 3.00 | 12.05 | 0.01 | 0.000 |

Analysis of BDO, 4-HB and succinate by GCMS. BDO, 4-HB and succinate in fermentation and cell culture samples were derivatized by silylation and quantitatively analyzed by GCMS using methods adapted from literature reports ((Simonov et al., *J. Anal Chem.* 59:965-971 (2004)). The developed method demonstrated good sensitivity down to 1 µM, linearity up to at least 25 mM, as well as excellent selectivity and reproducibility.

Sample preparation was performed as follows: 100 µL filtered (0.2 µm or 0.45 µm syringe filters) samples, e.g. fermentation broth, cell culture or standard solutions, were dried down in a Speed Vac Concentrator (Savant SVC-100H) for approximately 1 hour at ambient temperature, followed by the addition of 20 µL 10 mM cyclohexanol solution, as an internal standard, in dimethylformamide. The mixtures were vortexed and sonicated in a water bath (Branson 3510) for 15 min to ensure homogeneity. 100 µL silylation derivatization reagent, N,O-bis(trimethylsilyl)trifluoro-acetimide (BSTFA) with 1% trimethylchlorosilane, was added, and the mixture was incubated at 70° C. for 30 min. The derivatized samples were centrifuged for 5 min, and the clear solutions were directly injected into GCMS. All the chemicals and reagents were from Sigma-Aldrich, with the exception of BDO which was purchased from J. T. Baker.

GCMS was performed on an Agilent gas chromatograph 6890N, interfaced to a mass-selective detector (MSD) 5973N operated in electron impact ionization (EI) mode has been used for the analysis. ADB-5MS capillary column (J&W Scientific, Agilent Technologies), 30 m×0.25 mm i.d.×0.25 µm film thickness, was used. The GC was operated in a split injection mode introducing 1 µL of sample at 20:1 split ratio. The injection port temperature was 250° C. Helium was used as a carrier gas, and the flow rate was maintained at 1.0 mL/min. A temperature gradient program was optimized to ensure good resolution of the analytes of interest and minimum matrix interference. The oven was initially held at 80° C. for 1 min, then ramped to 120° C. at 2° C./min, followed by fast ramping to 320° C. at 100° C./min and final hold for 6 min at 320° C. The MS interface transfer line was maintained at 280° C. The data were acquired using 'lowmass' MS tune settings and 30-400 m/z mass-range scan. The total analysis time was 29 min including 3 min solvent delay. The retention times corresponded to 5.2, 10.5, 14.0 and 18.2 min for BSTFA-derivatized cyclohexanol, BDO, 4-HB and succinate, respectively. For quantitative analysis, the following specific mass fragments were selected (extracted ion chromatograms): m/z 157 for internal standard cyclohexanol, 116 for BDO, and 147 for both 4-HB and succinate. Standard calibration curves were constructed using analyte solutions in the corresponding cell culture or fermentation medium to match sample matrix as close as possible. GCMS data were processed using Environmental Data Analysis ChemStation software (Agilent Technologies).

The results indicated that most of the 4-HB and BDO produced were labeled with $^{13}C$ (FIG. 6, right-hand sides). Mass spectra from a parallel culture grown in unlabeled glucose are shown for comparison (FIG. 6, left-hand sides). Note that the peaks seen are for fragments of the derivatized molecule containing different numbers of carbon atoms from the metabolite. The derivatization reagent also contributes some carbon and silicon atoms that naturally-occurring label distribution, so the results are not strictly quantitative.

Production of BDO from 4-HB using alternate pathways. The various alternate pathways were also tested for BDO production. This includes use of the native *E. coli* SucCD enzyme to convert succinate to succinyl-CoA (Table 13, rows 2-3), use of α-ketoglutarate decarboxylase in the α-ketoglutarate pathway (Table 13, row 4), and use of PTB/BK as an alternate means to generate the CoA-derivative of 4HB (Table 13, row 1). Strains were constructed containing plasmids expressing the genes indicated in Table 13, which encompass these variants. The results show that in all cases, production of 4-HB and BDO occurred (Table 13).

TABLE 13

Production of BDO, 4-HB, and succinate in recombinant *E. coli* strains genes for different BDO pathway variants, grown anaerobically in minimal medium supplemented with 20 g/L glucose, and harvested 24 hours after induction with 0.1 mM IPTG. Concentrations are given in mM.

| Genes on pZE13 | Genes on pZA33 | Succinate | 4-HB | BDO |
|---|---|---|---|---|
| 0002 + 0004 + 0035 | 0020n-0021n-0036 | 0.336 | 2.91 | 0.230 |
| 0038 + 0035 | 0034-0036 | 0.814 | 2.81 | 0.126 |
| 0038 + 0035 | 0036-0034 | 0.741 | 2.57 | 0.114 |
| 0035 + 0032 | 0034-0036 | 5.01 | 0.538 | 0.154 |

Example III

Biosynthesis of 4-Hydroxybutanoic Acid, γ-Butyrolactone and 1,4-Butanediol

This Example describes the biosynthetic production of 4-hydroxybutanoic acid, γ-butyrolactone and 1,4-butanediol using fermentation and other bioprocesses. See corresponding Example in WO2013/184602.

Example IV

Exemplary BDO Pathways

This example describes exemplary enzymes and corresponding genes for 1,4-butandiol (BDO) synthetic pathways.

Exemplary BDO synthetic pathways are shown in FIGS. 8-13. The pathways depicted in FIGS. 8-13 are from common central metabolic intermediates to 1,4-butanediol. All transformations depicted in FIGS. 8-13 fall into the 18 general categories of transformations shown in Table 14. Below is described a number of biochemically characterized candidate genes in each category, as described in this and further Examples provided below. Thus, it is understood that a gene for carrying out a specified reaction can be utilized based on any of the disclosures herein, including various Examples, for the same or similar type of reaction. Specifically listed are genes that can be applied to catalyze the appropriate transformations in FIGS. 9-13 when cloned and expressed in a host organism. The top three exemplary genes for each of the key steps in FIGS. 9-13 are described in Tables 15 and 16 herein and in Tables 17-23 in WO2013/184602. Exemplary genes were provided for the pathways depicted in FIG. 8 are described herein.

TABLE 14

Enzyme types required to convert common central metabolic intermediates into 1,4-butanediol. The first three digits of each label correspond to the first three Enzyme Commission number digits which denote the general type of transformation independent of substrate specificity.

| Label | Function |
|---|---|
| 1.1.1.a | Oxidoreductase (ketone to hydroxyl or aldehyde to alcohol) |
| 1.1.1.c | Oxidoreductase (2 step, acyl-CoA to alcohol) |
| 1.2.1.b | Oxidoreductase (acyl-CoA to aldehyde) |
| 1.2.1.c | Oxidoreductase (2-oxo acid to acyl-CoA, decarboxylation) |
| 1.2.1.d | Oxidoreductase (phosphorylating/dephosphorylating) |
| 1.3.1.a | Oxidoreductase operating on CH—CH donors |
| 1.4.1.a | Oxidoreductase operating on amino acids |
| 2.3.1.a | Acyltransferase (transferring phosphate group) |
| 2.6.1.a | Aminotransferase |
| 2.7.2.a | Phosphotransferase, carboxyl group acceptor |
| 2.8.3.a | Coenzyme-A transferase |
| 3.1.2.a | Thiolester hydrolase (CoA specific) |
| 4.1.1.a | Carboxy-lyase |
| 4.2.1.a | Hydro-lyase |
| 4.3.1.a | Ammonia-lyase |
| 5.3.3.a | Isomerase |
| 5.4.3.a | Aminomutase |
| 6.2.1.a | Acid-thiol ligase |

1.1.1.a—Oxidoreductase (Aldehyde to Alcohol or Ketone to Hydroxyl)
Aldehyde to Alcohol.

Exemplary genes encoding enzymes that catalyze the conversion of an aldehyde to alcohol, that is, alcohol dehydrogenase or equivalently aldehyde reductase, include alrA encoding a medium-chain alcohol dehydrogenase for C2-C14 (Tani et al. *Appl. Environ. Microbiol.* 66:5231-5235 (2000)), ADH2 from *Saccharomyces cerevisiae* (Atsumi et al. *Nature* 451:86-89 (2008)), yqhD from *E. coli* which has preference for molecules longer than C(3) (Sulzenbacher et al. *Journal of Molecular Biology* 342:489-502 (2004)), and bdh I and bdh II from *C. acetobutylicum* which converts butyraldehyde into butanol (Walter et al. *Journal of Bacteriology* 174:7149-7158 (1992)). The protein sequences for each of these exemplary gene products, if available, can be found using the following GenBank accession numbers:

| Gene | Accession No. | GI No. | Organism |
|---|---|---|---|
| alrA | BAB12273.1 | 9967138 | *Acinetobacter* sp. Strain M-1 |
| ADH2 | NP_014032.1 | 6323961 | *Saccharomyces cerevisiae* |
| yqhD | NP_417484.1 | 16130909 | *Escherichia coli* |
| bdh I | NP_349892.1 | 15896543 | *Clostridium acetobutylicum* |
| bdh II | NP_349891.1 | 15896542 | *Clostridium acetobutylicum* |

Enzymes exhibiting 4-hydroxybutyrate dehydrogenase activity (EC 1.1.1.61) also fall into this category. Such enzymes have been characterized in *Ralstonia eutropha* (Bravo et al. *J. Forensic Sci.* 49:379-387 (2004), *Clostridium kluyveri* (Wolff et al. *Protein Expr. Purif* 6:206-212 (1995)) and *Arabidopsis thaliana* (Breitkreuz et al. *J. Biol. Chem.* 278:41552-41556 (2003)).

| Gene | Accession No. | GI No. | Organism |
|---|---|---|---|
| 4hbd | YP_726053.1 | 113867564 | *Ralstonia eutropha* H16 |
| 4hbd | L21902.1 | 146348486 | *Clostridium kluyveri* DSM 555 |
| 4hbd | Q94B07 | 75249805 | *Arabidopsis thaliana* |

Another exemplary enzyme is 3-hydroxyisobutyrate dehydrogenase which catalyzes the reversible oxidation of 3-hydroxyisobutyrate to methylmalonate semialdehyde. This enzyme participates in valine, leucine and isoleucine degradation and has been identified in bacteria, eukaryotes, and mammals. The enzyme encoded by P84067 from *Thermus thermophilus* HB8 has been structurally characterized (Lokanath et al. *J Mol Biol* 352:905-17 (2005)). The reversibility of the human 3-hydroxyisobutyrate dehydrogenase was demonstrated using isotopically-labeled substrate (Manning et al. *Biochem J* 231:481-484 (1985)). Additional genes encoding this enzyme include 3hidh in *Homo sapiens* (Hawes et al. *Methods Enzymol.* 324:218-228 (2000)) and *Oryctolagus cuniculus* (Chowdhury et al. *Biosci. Biotechnol Biochem.* 60:2043-2047 (1996); Hawes et al. *Methods Enzymol.* 324:218-228 (2000)), mmsb in *Pseudomonas aeruginosa*, and dhat in *Pseudomonas putida* (Aberhart et al. *J Chem. Soc. [Perkin 1]* 6:1404-1406 (1979); Chowdhury et al. *Biosci. Biotechnol Biochem.* 67:438-441 (2003); Chowdhury et al. *Biosci. Biotechnol Biochem.* 60:2043-2047 (1996)).

| Gene | Accession No. | GI No. | Organism |
|---|---|---|---|
| P84067 | P84067 | 75345323 | *Thermus thermophilus* |
| mmsb | P28811.1 | 127211 | *Pseudomonas aeruginosa* |
| dhat | Q59477.1 | 2842618 | *Pseudomonas putida* |
| 3hidh | P31937.2 | 12643395 | *Homo sapiens* |
| 3hidh | P32185.1 | 416872 | *Oryctolagus cuniculus* |

Several 3-hydroxyisobutyrate dehydrogenase enzymes have also been shown to convert malonic semialdehyde to 3-hydroxyproprionic acid (3-HP). Three gene candidates exhibiting this activity are mmsB from *Pseudomonas aeruginosa* PAO1(62), mmsB from *Pseudomonas putida*

KT2440 (Liao et al., US Publication 2005/0221466) and mmsB from *Pseudomonas putida* E23 (Chowdhury et al., *Biosci. Biotechnol. Biochem.* 60:2043-2047 (1996)). An enzyme with 3-hydroxybutyrate dehydrogenase activity in *Alcaligenes faecalis* M3A has also been identified (Gokam et al., U.S. Pat. No. 7,393,676; Liao et al., US Publication No. 2005/0221466). Additional gene candidates from other organisms including *Rhodobacter spaeroides* can be inferred by sequence similarity.

| Gene | Accession No. | GI No. | Organism |
| --- | --- | --- | --- |
| mmsB | AAA25892.1 | 151363 | *Pseudomonas aeruginosa* |
| mmsB | NP_252259.1 | 15598765 | *Pseudomonas aeruginosa* PAO1 |
| mmsB | NP_746775.1 | 26991350 | *Pseudomonas putida* KT2440 |
| mmsB | JC7926 | 60729613 | *Pseudomonas putida* E23 |
| orfB1 | AAL26884 | 16588720 | *Rhodobacter spaeroides* |

The conversion of malonic semialdehyde to 3-HP can also be accomplished by two other enzymes: NADH-dependent 3-hydroxypropionate dehydrogenase and NADPH-dependent malonate semialdehyde reductase. An NADH-dependent 3-hydroxypropionate dehydrogenase is thought to participate in beta-alanine biosynthesis pathways from propionate in bacteria and plants (Rathinasabapathi, B. *Journal of Plant Pathology* 159:671-674 (2002); Stadtman, E. R. *J. Am. Chem. Soc.* 77:5765-5766 (1955)). This enzyme has not been associated with a gene in any organism to date. NADPH-dependent malonate semialdehyde reductase catalyzes the reverse reaction in autotrophic $CO_2$-fixing bacteria. Although the enzyme activity has been detected in *Metallosphaera sedula*, the identity of the gene is not known (Alber et al. *J. Bacteriol.* 188:8551-8559 (2006)).

Ketone to Hydroxyl.

There exist several exemplary alcohol dehydrogenases that convert a ketone to a hydroxyl functional group. Two such enzymes from *E. coli* are encoded by malate dehydrogenase (mdh) and lactate dehydrogenase (ldhA). In addition, lactate dehydrogenase from *Ralstonia eutropha* has been shown to demonstrate high activities on substrates of various chain lengths such as lactate, 2-oxobutyrate, 2-oxopentanoate and 2-oxoglutarate (Steinbuchel and. Schlegel, *Eur. J. Biochem.* 130:329-334 (1983)). Conversion of alpha-ketoadipate into alpha-hydroxyadipate can be catalyzed by 2-ketoadipate reductase, an enzyme reported to be found in rat and in human placenta (Suda et al. *Arch. Biochem. Biophys.* 176:610-620 (1976); Suda et al. *Biochem. Biophys. Res. Commun.* 77:586-591 (1977)). An additional candidate for this step is the mitochondrial 3-hydroxybutyrate dehydrogenase (bah) from the human heart which has been cloned and characterized (Marks et al. *J. Biol. Chem.* 267:15459-15463 (1992)). This enzyme is a dehydrogenase that operates on a 3-hydroxyacid. Another exemplary alcohol dehydrogenase converts acetone to isopropanol as was shown in *C. beijerinckii* (Ismaiel et al. *J. Bacteriol.* 175:5097-5105 (1993)) and *T. brockii* (Lamed et al. *Biochem. J.* 195:183-190 (1981); Peretz and Burstein *Biochemistry* 28:6549-6555 (1989)).

| Gene | Accession No. | GI No. | Organism |
| --- | --- | --- | --- |
| mdh | AAC76268.1 | 1789632 | *Escherichia coli* |
| ldhA | NP_415898.1 | 16129341 | *Escherichia coli* |
| ldh | YP_725182.1 | 113866693 | *Ralstonia eutropha* |
| bdh | AAA58352.1 | 177198 | *Homo sapiens* |

| Gene | Accession No. | GI No. | Organism |
| --- | --- | --- | --- |
| adh | AAA23199.2 | 60592974 | *Clostridium beijerinckii* NRRL B593 |
| adh | P14941.1 | 113443 | *Thermoanaerobacter brockii* HTD4 |

Exemplary 3-hydroxyacyl dehydrogenases which convert acetoacetyl-CoA to 3-hydroxybutyryl-CoA include hbd from *C. acetobutylicum* (Boynton et al. *Journal of Bacteriology* 178:3015-3024 (1996)), hbd from *C. beijerinckii* (Colby et al. *Appl Environ Microbiol* 58:3297-3302 (1992)), and a number of similar enzymes from *Metallosphaera sedula* (Berg et al. Archaea. *Science* 318:1782-1786 (2007)).

| Gene | Accession No. | GI No. | Organism |
| --- | --- | --- | --- |
| hbd | NP_349314.1 | 15895965 | *Clostridium acetobutylicum* |
| hbd | AAM14586.1 | 20162442 | *Clostridium beijerinckii* |
| Msed_1423 | YP_001191505 | 146304189 | *Metallosphaera sedula* |
| Msed_0399 | YP_001190500 | 146303184 | *Metallosphaera sedula* |
| Msed_0389 | YP_001190490 | 146303174 | *Metallosphaera sedula* |
| Msed_1993 | YP_001192057 | 146304741 | *Metallosphaera sedula* |

1.1.1.c—Oxidoredutase (2 Step, Acyl-CoA to Alcohol)

Exemplary 2-step oxidoreductases that convert an acyl-CoA to alcohol include those that transform substrates such as acetyl-CoA to ethanol (for example, adhE from *E. coli* (Kessler et al. *FEBS. Lett.* 281:59-63 (1991)) and butyryl-CoA to butanol (for example, adhE2 from *C. acetobutylicum* (Fontaine et al. *J. Bacteriol.* 184:821-830 (2002)). In addition to reducing acetyl-CoA to ethanol, the enzyme encoded by adhE in *Leuconostoc mesenteroides* has been shown to oxide the branched chain compound isobutyraldehyde to isobutyryl-CoA (Kazahaya et al. *J. Gen. Appl. Microbiol.* 18:43-55 (1972); Koo et al. *Biotechnol Lett.* 27:505-510 (2005)).

| Gene | Accession No. | GI No. | Organism |
| --- | --- | --- | --- |
| adhE | NP_415757.1 | 16129202 | *Escherichia coli* |
| adhE2 | AAK09379.1 | 12958626 | *Clostridium acetobutylicum* |
| adhE | AAV66076.1 | 55818563 | *Leuconostoc mesenteroides* |

Another exemplary enzyme can convert malonyl-CoA to 3-HP. An NADPH-dependent enzyme with this activity has characterized in *Chloroflexus aurantiacus* where it participates in the 3-hydroxypropionate cycle (Hugler et al., *J. Bacteriol.* 184:2404-2410 (2002); Strauss and Fuchs, *Eur. J. Biochem.* 215:633-643 (1993)). This enzyme, with a mass of 300 kDa, is highly substrate-specific and shows little sequence similarity to other known oxidoreductases (Hugler et al., *J. Bacteriol.* 184:2404-2410 (2002)). No enzymes in other organisms have been shown to catalyze this specific reaction; however there is bioinformatic evidence that other organisms may have similar pathways (Klatt et al., *Environ. Microbiol.* 9:2067-2078 (2007)). Enzyme candidates in other organisms including *Roseiflexus castenholzii*, *Erythrobacter* sp. NAP1 and marine gamma proteobacterium HTCC2080 can be inferred by sequence similarity.

| Gene | Accession No. | GI No. | Organism |
|---|---|---|---|
| mcr | AAS20429.1 | 42561982 | *Chloroflexus aurantiacus* |
| Rcas_2929 | YP_001433009.1 | 156742880 | *Roseiflexus castenholzii* |
| NAP1_02720 | ZP_01039179.1 | 85708113 | *Erythrobacter* sp. NAP1 |
| MGP2080_00535 | ZP_01626393.1 | 119504313 | marine gamma proteobacterium HTCC2080 |

Longer chain acyl-CoA molecules can be reduced by enzymes such as the jojoba (*Simmondsia chinensis*) FAR which encodes an alcohol-forming fatty acyl-CoA reductase. Its overexpression in *E. coli* resulted in FAR activity and the accumulation of fatty alcohol (Metz et al. *Plant Physiology* 122:635-644) 2000)).

| Gene | Accession No. | GI No. | Organism |
|---|---|---|---|
| FAR | AAD38039.1 | 5020215 | *Simmondsia chinensis* |

1.2.1.b—Oxidoreductase (Acyl-CoA to Aldehyde)

Several acyl-CoA dehydrogenases are capable of reducing an acyl-CoA to its corresponding aldehyde. Exemplary genes that encode such enzymes include the *Acinetobacter calcoaceticus* acr1 encoding a fatty acyl-CoA reductase (Reiser and Somerville, *J. Bacteriology* 179:2969-2975 (1997)), the *Acinetobacter* sp. M-1 fatty acyl-CoA reductase (Ishige et al. *Appl. Environ. Microbiol.* 68:1192-1195 (2002)), and a CoA- and NADP-dependent succinate semialdehyde dehydrogenase encoded by the sucD gene in *Clostridium kluyveri* (Sohling and Gottschalk *J Bacteriol* 178:871-80 (1996); Sohling and Gottschalk *J Bacteriol.* 178:871-880 (1996)). SucD of *P. gingivalis* is another succinate semialdehyde dehydrogenase (Takahashi et al. *J. Bacteriol.* 182:4704-4710 (2000)). The enzyme acylating acetaldehyde dehydrogenase in *Pseudomonas* sp, encoded by bphG, is yet another as it has been demonstrated to oxidize and acylate acetaldehyde, propionaldehyde, butyraldehyde, isobutyraldehyde and formaldehyde (Powlowski et al. *J Bacteriol.* 175:377-385 (1993)).

| Gene | Accession No. | GI No. | Organism |
|---|---|---|---|
| acr1 | YP_047869.1 | 50086359 | *Acinetobacter calcoaceticus* |
| acr1 | AAC45217 | 1684886 | *Acinetobacter baylyi* |
| acr1 | BAB85476.1 | 18857901 | *Acinetobacter* sp. Strain M-1 |
| sucD | P38947.1 | 730847 | *Clostridium kluyveri* |
| sucD | NP_904963.1 | 34540484 | *Porphyromonas gingivalis* |
| bphG | BAA03892.1 | 425213 | *Pseudomonas* sp |

An additional enzyme type that converts an acyl-CoA to its corresponding aldehyde is malonyl-CoA reductase which transforms malonyl-CoA to malonic semialdehyde. Malonyl-CoA reductase is a key enzyme in autotrophic carbon fixation via the 3-hydroxypropionate cycle in thermoacidophilic archael bacteria (Berg et al. *Science* 318:1782-1786 (2007); Thauer, R. K. *Science* 318:1732-1733 (2007)). The enzyme utilizes NADPH as a cofactor and has been characterized in *Metallosphaera* and *Sulfolobus* spp (Alber et al. *J. Bacteriol.* 188:8551-8559 (2006); Hugler et al. *J. Bacteriol.* 184:2404-2410 (2002)). The enzyme is encoded by Msed_0709 in *Metallosphaera sedula* (Alber et al. *J. Bacteriol.* 188:8551-8559 (2006); Berg et al. *Science* 318:1782-1786 (2007)). A gene encoding a malonyl-CoA reductase from *Sulfolobus tokodaii* was cloned and heterologously expressed in *E. coli* (Alber et al. *J. Bacteriol.* 188:8551-8559 (2006)). Although the aldehyde dehydrogenase functionality of these enzymes is similar to the bifunctional dehydrogenase from *Chloroflexus aurantiacus*, there is little sequence similarity. Both malonyl-CoA reductase enzyme candidates have high sequence similarity to aspartate-semialdehyde dehydrogenase, an enzyme catalyzing the reduction and concurrent dephosphorylation of aspartyl-4-phosphate to aspartate semialdehyde. Additional gene candidates can be found by sequence homology to proteins in other organisms including *Sulfolobus solfataricus* and *Sulfolobus acidocaldarius*.

| Gene | Accession No. | GI No. | Organism |
|---|---|---|---|
| Msed_0709 | YP_001190808.1 | 146303492 | *Metallosphaera sedula* |
| mcr | NP_378167.1 | 15922498 | *Sulfolobus tokodaii* |
| asd-2 | NP_343563.1 | 15898958 | *Sulfolobus solfataricus* |
| Saci_2370 | YP_256941.1 | 70608071 | *Sulfolobus acidocaldarius* |

1.2.1.c—Oxidoreductase (2-Oxo Acid to Acyl-CoA, Decarboxylation)

Enzymes in this family include 1) branched-chain 2-keto-acid dehydrogenase, 2) alpha-ketoglutarate dehydrogenase, and 3) the pyruvate dehydrogenase multienzyme complex (PDHC). These enzymes are multi-enzyme complexes that catalyze a series of partial reactions which result in acylating oxidative decarboxylation of 2-keto-acids. Each of the 2-keto-acid dehydrogenase complexes occupies key positions in intermediary metabolism, and enzyme activity is typically tightly regulated (Fries et al. *Biochemistry* 42:6996-7002 (2003)). The enzymes share a complex but common structure composed of multiple copies of three catalytic components: alpha-ketoacid decarboxylase (E1), dihydrolipoamide acyltransferase (E2) and dihydrolipoamide dehydrogenase (E3). The E3 component is shared among all 2-keto-acid dehydrogenase complexes in an organism, while the E1 and E2 components are encoded by different genes. The enzyme components are present in numerous copies in the complex and utilize multiple cofactors to catalyze a directed sequence of reactions via substrate channeling. The overall size of these dehydrogenase complexes is very large, with molecular masses between 4 and 10 million Da (that is, larger than a ribosome).

Activity of enzymes in the 2-keto-acid dehydrogenase family is normally low or limited under anaerobic conditions in *E. coli*. Increased production of NADH (or NADPH) could lead to a redox-imbalance, and NADH itself serves as an inhibitor to enzyme function. Engineering efforts have increased the anaerobic activity of the *E. coli* pyruvate dehydrogenase complex (Kim et al. *Appl. Environ. Microbiol.* 73:1766-1771 (2007); Kim et al. *J. Bacteriol.* 190: 3851-3858) 2008); Zhou et al. *Biotechnol. Lett.* 30:335-342 (2008)). For example, the inhibitory effect of NADH can be overcome by engineering an H322Y mutation in the E3 component (Kim et al. *J. Bacteriol.* 190:3851-3858 (2008)). Structural studies of individual components and how they work together in complex provide insight into the catalytic mechanisms and architecture of enzymes in this family (Aevarsson et al. *Nat. Struct. Biol.* 6:785-792 (1999); Zhou et al. *Proc. Natl. Acad. Sci. U.S.A.* 98:14802-14807 (2001)).

The substrate specificity of the dehydrogenase complexes varies in different organisms, but generally branched-chain keto-acid dehydrogenases have the broadest substrate range.

Alpha-ketoglutarate dehydrogenase (AKGD) converts alpha-ketoglutarate to succinyl-CoA and is the primary site of control of metabolic flux through the TCA cycle (Hansford, R. G *Curr. Top. Bioenerg.* 10:217-278 (1980)). Encoded by genes sucA, sucB and lpd in *E. coli*, AKGD gene expression is downregulated under anaerobic conditions and during growth on glucose (Park et al. *Mol. Microbiol.* 15:473-482 (1995)). Although the substrate range of AKGD is narrow, structural studies of the catalytic core of the E2 component pinpoint specific residues responsible for substrate specificity (Knapp et al. *J. Mol. Biol.* 280:655-668 (1998)). The *Bacillus subtilis* AKGD, encoded by odhAB (E1 and E2) and pdhD (E3, shared domain), is regulated at the transcriptional level and is dependent on the carbon source and growth phase of the organism (Resnekov et al. *Mol. Gen. Genet.* 234:285-296 (1992)). In yeast, the LPD1 gene encoding the E3 component is regulated at the transcriptional level by glucose (Roy and Dawes *J. Gen. Microbiol.* 133:925-933 (1987)). The E1 component, encoded by KGD1, is also regulated by glucose and activated by the products of HAP2 and HAP3 (Repetto and Tzagoloff *Mol. Cell Biol.* 9:2695-2705 (1989)). The AKGD enzyme complex, inhibited by products NADH and succinyl-CoA, is well-studied in mammalian systems, as impaired function of has been linked to several neurological diseases (Tretter and dam-Vizi *Philos. Trans. R. Soc. Lond B Biol. Sci.* 360:2335-2345 (2005)).

| Gene | Accession No. | GI No. | Organism |
|------|---------------|--------|----------|
| sucA | NP_415254.1 | 16128701 | *Escherichia coli* str. K12 substr. MG1655 |
| sucB | NP_415255.1 | 16128702 | *Escherichia coli* str. K12 substr. MG1655 |
| lpd | NP_414658.1 | 16128109 | *Escherichia coli* str. K12 substr. MG1655 |
| odhA | P23129.2 | 51704265 | *Bacillus subtilis* |
| odhB | P16263.1 | 129041 | *Bacillus subtilis* |
| pdhD | P21880.1 | 118672 | *Bacillus subtilis* |
| KGD1 | NP_012141.1 | 6322066 | *Saccharomyces cerevisiae* |
| KGD2 | NP_010432.1 | 6320352 | *Saccharomyces cerevisiae* |
| LPD1 | NP_116635.1 | 14318501 | *Saccharomyces cerevisiae* |

Branched-chain 2-keto-acid dehydrogenase complex (BCKAD), also known as 2-oxoisovalerate dehydrogenase, participates in branched-chain amino acid degradation pathways, converting 2-keto acids derivatives of valine, leucine and isoleucine to their acyl-CoA derivatives and $CO_2$. The complex has been studied in many organisms including *Bacillus subtilis* (Wang et al. *Eur. J. Biochem.* 213:1091-1099 (1993)), *Rattus norvegicus* (Namba et al. *J. Biol. Chem.* 244:4437-4447 (1969)) and *Pseudomonas putida* (Sokatch *J. Bacteriol.* 148:647-652 (1981)). In *Bacillus subtilis* the enzyme is encoded by genes pdhD (E3 component), bfmnBB (E2 component), bfmBAA and bfmBAB (E1 component) (Wang et al. *Eur. J. Biochem.* 213:1091-1099 (1993)). In mammals, the complex is regulated by phosphorylation by specific phosphatases and protein kinases. The complex has been studied in rat hepatocites (Chicco et al. *J. Biol. Chem.* 269:19427-19434 (1994)) and is encoded by genes Bckdha (E1 alpha), Bckdhb (E1 beta), Dbt (E2), and Did (E3). The E1 and E3 components of the *Pseudomonas putida* BCKAD complex have been crystallized (Aevarsson et al. *Nat. Struct. Biol.* 6:785-792 (1999); Mattevi *Science* 255:1544-1550 (1992)) and the enzyme complex has been studied (Sokatch et al. *J. Bacteriol.* 148:647-652 (1981)). Transcription of the *P. putida* BCKAD genes is activated by the gene product of bkdR (Hester et al. *Eur. Biochem.* 233:828-836 (1995)). In some organisms including *Rattus norvegicus* (Paxton et al. *Biochem. J.* 234:295-303 (1986)) and *Saccharomyces cerevisiae* (Sinclair et al. *Biochem. Mol. Biol. Int.* 31:911-922 (1993)), this complex has been shown to have a broad substrate range that includes linear oxo-acids such as 2-oxobutanoate and alpha-ketoglutarate, in addition to the branched-chain amino acid precursors. The active site of the bovine BCKAD was engineered to favor alternate substrate acetyl-CoA (Meng and Chuang, *Biochemistry* 33:12879-12885 (1994)).

| Gene | Accession No. | GI No. | Organism |
|------|---------------|--------|----------|
| bfmBB | NP_390283.1 | 16079459 | *Bacillus subtilis* |
| bfmBAA | NP_390285.1 | 16079461 | *Bacillus subtilis* |
| bfmBAB | NP_390284.1 | 16079460 | *Bacillus subtilis* |
| pdhD | P21880.1 | 118672 | *Bacillus subtilis* |
| lpdV | P09063.1 | 118677 | *Pseudomonas putida* |
| bkdB | P09062.1 | 129044 | *Pseudomonas putida* |
| bkdA1 | NP_746515.1 | 26991090 | *Pseudomonas putida* |
| bkdA2 | NP_746516.1 | 26991091 | *Pseudomonas putida* |
| Bckdha | NP_036914.1 | 77736548 | *Rattus norvegicus* |
| Bckdhb | NP_062140.1 | 158749538 | *Rattus norvegicus* |
| Dbt | NP_445764.1 | 158749632 | *Rattus norvegicus* |
| Dld | NP_955417.1 | 40786469 | *Rattus norvegicus* |

The pyruvate dehydrogenase complex, catalyzing the conversion of pyruvate to acetyl-CoA, has also been extensively studied. In the *E. coli* enzyme, specific residues in the E1 component are responsible for substrate specificity (Bisswanger, H. *J Biol Chem.* 256:815-822 (1981); Bremer, *J. Eur. J. Biochem.* 8:535-540 (1969); Gong et al. *J Biol Chem.* 275:13645-13653 (2000)). As mentioned previously, enzyme engineering efforts have improved the *E. coli* PDH enzyme activity under anaerobic conditions (Kim et al. *Appl. Environ. Microbiol.* 73:1766-1771 (2007); Kim *J. Bacteriol.* 190:3851-3858 (2008); Zhou et al. *Biotechnol. Lett.* 30:335-342 (2008)). In contrast to the *E. coli* PDH, the *B. subtilis* complex is active and required for growth under anaerobic conditions (Nakano *J. Bacteriol.* 179:6749-6755 (1997)). The *Klebsiella pneumnoniae* PDH, characterized during growth on glycerol, is also active under anaerobic conditions (Menzel et al. *J. Biotechnol.* 56:135-142 (1997)). Crystal structures of the enzyme complex from bovine kidney (Zhou et al. *Proc. Natl. Acad. Sci. U.S.A.* 98:14802-14807 (2001)) and the E2 catalytic domain from *Azotobacter vinelandii* are available (Mattevi et al. *Science* 255:1544-1550 (1992)). Some mammalian PDH enzymes complexes can react on alternate substrates such as 2-oxobutanoate, although comparative kinetics of *Rattus norvegicus* PDH and BCKAD indicate that BCKAD has higher activity on 2-oxobutanoate as a substrate (Paxton et al. *Biochem. J.* 234:295-303 (1986)).

| Gene | Accession No. | GI No. | Organism |
|------|---------------|--------|----------|
| aceE | NP_414656.1 | 16128107 | *Escherichia coli* str. K12 substr. MG1655 |
| aceF | NP_414657.1 | 16128108 | *Escherichia coli* str. K12 substr. MG1655 |
| lpd | NP_414658.1 | 16128109 | *Escherichia coli* str. K12 substr. MG1655 |
| pdhA | P21881.1 | 3123238 | *Bacillus subtilis* |
| pdhB | P21882.1 | 129068 | *Bacillus subtilis* |
| pdhC | P21883.2 | 129054 | *Bacillus subtilis* |

| Gene | Accession No. | GI No. | Organism |
| --- | --- | --- | --- |
| pdhD | P21880.1 | 118672 | Bacillus subtilis |
| aceE | YP_001333808.1 | 152968699 | Klebsiella pneumonia MGH78578 |
| aceF | YP_001333809.1 | 152968700 | Klebsiella pneumonia MGH78578 |
| lpdA | YP_001333810.1 | 152968701 | Klebsiella pneumonia MGH78578 |
| Pdha1 | NP_001004072.2 | 124430510 | Rattus norvegicus |
| Pdha2 | NP_446446.1 | 16758900 | Rattus norvegicus |
| Dlat | NP_112287.1 | 78365255 | Rattus norvegicus |
| Dld | NP_955417.1 | 40786469 | Rattus norvegicus |

As an alternative to the large multienzyme 2-keto-acid dehydrogenase complexes described above, some anaerobic organisms utilize enzymes in the 2-ketoacid oxidoreductase family (OFOR) to catalyze acylating oxidative decarboxylation of 2-keto-acids. Unlike the dehydrogenase complexes, these enzymes contain iron-sulfur clusters, utilize different cofactors, and use ferredoxin or flavodixin as electron acceptors in lieu of NAD(P)H. While most enzymes in this family are specific to pyruvate as a substrate (POR) some 2-keto-acid:ferredoxin oxidoreductases have been shown to accept a broad range of 2-ketoacids as substrates including alpha-ketoglutarate and 2-oxobutanoate (Fukuda and Wakagi *Biochim. Biophys. Acta* 1597:74-80 (2002); Zhang et al. *J. Biochem.* 120:587-599 (1996)). One such enzyme is the OFOR from the thermoacidophilic archaeon *Sulfolobus tokodaii* 7, which contains an alpha and beta subunit encoded by gene ST2300 (Fukuda and Wakagi *Biochim. Biophys. Acta* 1597:74-80 (2002); Zhang et al. *J. Biochem.* 120:587-599 (1996)). A plasmid-based expression system has been developed for efficiently expressing this protein in *E. coli* (Fukuda et al. *Eur. J. Biochem.* 268:5639-5646 (2001)) and residues involved in substrate specificity were determined (Fukuda and Wakagi *Biochim. Biophys. Acta* 1597:74-80 (2002)). Two OFORs from *Aeropyrum pernix* str.K1 have also been recently cloned into *E. coli*, characterized, and found to react with a broad range of 2-oxoacids (Nishizawa et al. *FEBS Lett.* 579:2319-2322 (2005)). The gene sequences of these OFOR candidates are available, although they do not have GenBank identifiers assigned to date. There is bioinformatic evidence that similar enzymes are present in all archaea, some anaerobic bacteria and amitochondrial eukarya (Fukuda and Wakagi *Biochim. Biophys. Acta* 1597:74-80 (2005)). This class of enzyme is also interesting from an energetic standpoint, as reduced ferredoxin could be used to generate NADH by ferredoxin-NAD reductase (Petitdemange et al. *Biochim. Biophys. Acta* 421: 334-337 (1976)). Also, since most of the enzymes are designed to operate under anaerobic conditions, less enzyme engineering may be required relative to enzymes in the 2-keto-acid dehydrogenase complex family for activity in an anaerobic environment.

| Gene | Accession No. | GI No. | Organism |
| --- | --- | --- | --- |
| ST2300 | NP_378302.1 | 15922633 | Sulfolobus tokodaii 7 |

1.2.1.d—Oxidoreductase (Phosphorylating/Dephosphorylating)

Exemplary enzymes in this class include glyceraldehyde 3-phosphate dehydrogenase which converts glyceraldehyde-3-phosphate into D-glycerate 1,3-bisphosphate (for example, *E. coli* gapA (Branlant and Branlant *Eur. J. Biochem.* 150:61-66(1985)), aspartate-semialdehyde dehydrogenase which converts L-aspartate-4-semialdehyde into L-4-aspartyl-phosphate (for example, *E. coli* asd (Biellmann et al. *Eur. J. Biochem.* 104:53-58 (1980)), N-acetyl-gamma-glutamyl-phosphate reductase which converts N-acetyl-L-glutamate-5-semialdehyde into N-acetyl-L-glutamyl-5-phosphate (for example, *E. coli* argC (Parsot et al. *Gene* 68:275-283 (1988)), and glutamate-5-semialdehyde dehydrogenase which converts L-glutamate-5-semialdehyde into L-glutamyl-5-phosphate (for example, *E. coli* proA (Smith et al. *J. Bacteriol.* 157:545-551 (1984)).

| Gene | Accession No. | GI No. | Organism |
| --- | --- | --- | --- |
| gapA | P0A9B2.2 | 71159358 | Escherichia coli |
| asd | NP_417891.1 | 16131307 | Escherichia coli |
| argC | NP_418393.1 | 16131796 | Escherichia coli |
| proA | NP_414778.1 | 16128229 | Escherichia coli |

1.3.1.a—Oxidoreductase Operating on CH-CH Donors

An exemplary enoyl-CoA reductase is the gene product of bcd from *C. acetobutylicum* (Atsumi et al. *Metab Eng* (2007); Boynton et al. *Journal of Bacteriology* 178:3015-3024 (1996), which naturally catalyzes the reduction of crotonyl-CoA to butyryl-CoA. Activity of this enzyme can be enhanced by expressing bcd in conjunction with expression of the *C. acetobutylicum* etfAB genes, which encode an electron transfer flavoprotein. An additional candidate for the enoyl-CoA reductase step is the mitochondrial enoyl-CoA reductase from *E. gracilis* (Hoffmeister et al. *Journal of Biological Chemistry* 280:4329-4338 (2005)). A construct derived from this sequence following the removal of its mitochondrial targeting leader sequence was cloned in *E. coli* resulting in an active enzyme (Hoffmeister et al., supra, (2005)). This approach is well known to those skilled in the art of expressing eukaryotic genes, particularly those with leader sequences that may target the gene product to a specific intracellular compartment, in prokaryotic organisms. A close homolog of this gene, TDE0597, from the prokaryote *Treponema denticola* represents a third enoyl-CoA reductase which has been cloned and expressed in *E. coli* (Tucci and Martin *FEBS Letters* 581:1561-1566 (2007)). Gene Accession No. GI No. Organism

| Gene | Accession No. | GI No. | Organism |
| --- | --- | --- | --- |
| bcd | NP_349317.1 | 15895968 | Clostridium acetobutylicum |
| etfA | NP_349315.1 | 15895966 | Clostridium acetobutylicum |
| etfB | NP_349316.1 | 15895967 | Clostridium acetobutylicum |
| TER | Q5EU90.1 | 62287512 | Euglena gracilis |
| TDE0597 | NP_971211.1 | 42526113 | Treponema denticola |

Exemplary 2-enoate reductase (EC 1.3.1.31) enzymes are known to catalyze the NADH-dependent reduction of a wide variety of ca, P-unsaturated carboxylic acids and aldehydes (Rohdich et al. *J. Biol. Chem.* 276:5779-5787 (2001)). 2-Enoate reductase is encoded by enr in several species of *Clostridia* (Giesel and Simon *Arch Microbiol.* 135(1): p. 51-57 (2001) including *C. tyrobutyricum*, and *C. thermoaceticum* (now called *Moorella thermoaceticum*) (Rohdich et al., supra, (2001)). In the recently published genome sequence of *C. kluyveri*, 9 coding sequences for enoate reductases have been reported, out of which one has been characterized (Seedorf et al. *Proc Natl Acad Sci U.S.A.* 105(6):2128-33 (2008)). The enr genes from both *C. tyrobutyricum* and *C. thermoaceticum* have been cloned and sequenced and show 59% identity to each other. The former gene is also found to have approximately 75% similarity to the characterized gene in *C. kluyveri* (Giesel and Simon *Arch Microbiol* 135(1):51-57 (1983)). It has been reported based on these sequence results that enr is very similar to the dienoyl CoA reductase in *E. coli* (fadH) (163 Rohdich et al., supra (2001)). The *C. thermoaceticum* enr gene has also been expressed in an enzymatically active form in *E. coli* (163 Rohdich et al., supra (2001)).

| Gene | Accession No. | GI No. | Organism |
| --- | --- | --- | --- |
| fadH | NP_417552.1 | 16130976 | *Escherichia coli* |
| enr | ACA54153.1 | 169405742 | *Clostridium botulinum* A3 str |
| enr | CAA71086.1 | 2765041 | *Clostridium tyrobutyricum* |
| enr | CAA76083.1 | 3402834 | *Clostridium kluyveri* |
| enr | YP_430895.1 | 83590886 | *Moorella thermoacetica* |

1.4.1.a—Oxidoreductase Operating on Amino Acids

Most oxidoreductases operating on amino acids catalyze the oxidative deamination of alpha-amino acids with NAD+ or NADP+ as acceptor. Exemplary oxidoreductases operating on amino acids include glutamate dehydrogenase (deaminating), encoded by gdhA, leucine dehydrogenase (deaminating), encoded by ldh, and aspartate dehydrogenase (deaminating), encoded by nadX The gdA gene product from *Escherichia coli* (Korber et al. *J. Mol. Biol.* 234:1270-1273 (1993); McPherson and Wootton *Nucleic. Acids Res.* 11:5257-5266 (1983)), gdh from *Thermotoga maritima* (Kort et al. *Extremophiles* 1:52-60 (1997); Lebbink, et al. *J. Mol. Biol.* 280:287-296 (1998)); Lebbink et al. *J. Mol. Biol.* 289:357-369 (1999)), and gdhA1 from *Halobacterium salinarum* (Ingoldsby et al. *Gene* 349:237-244 (2005)) catalyze the reversible interconversion of glutamate to 2-oxoglutarate and ammonia, while favoring NADP(H), NAD(H), or both, respectively. The lad gene of *Bacillus cereus* encodes the LeuDH protein that has a wide of range of substrates including leucine, isoleucine, valine, and 2-aminobutanoate (Ansorge and Kula *Biotechnol Bioeng.* 68:557-562 (2000); Stoyan et al. *J. Biotechnol* 54:77-80 (1997)). The nadX gene from *Thermotoga maritime* encoding for the aspartate dehydrogenase is involved in the biosynthesis of NAD (Yang et al. *J. Biol. Chem.* 278:8804-8808 (2003)).

| Gene | Accession No. | GI No. | Organism |
| --- | --- | --- | --- |
| gdhA | P00370 | 118547 | *Escherichia coli* |
| gdh | P96110.4 | 6226595 | *Thermotoga maritima* |
| gdhA1 | NP_279651.1 | 15789827 | *Halobacterium salinarum* |
| ldh | P0A393 | 61222614 | *Bacillus cereus* |
| nadX | NP_229443.1 | 15644391 | *Thermotoga maritima* |

The lysine 6-dehydrogenase (deaminating), encoded by lysDH gene, catalyze the oxidative deamination of the ε-amino group of L-lysine to form 2-aminoadipate-6-semi-aldehyde, which in turn nonenzymatically cyclizes to form Δ1-piperideine-6-carboxylate (Misono and Nagasaki *J. Bacteriol.* 150:398-401 (1982)). The lysDH gene from *Geobacillus stearothermophilus* encodes a thermophilic NAD-dependent lysine 6-dehydrogenase (Heydari et al. *Appl Environ. Microbiol* 70:937-942 (2004)). In addition, the lysDH gene from *Aeropyrum pernix* K1 is identified through homology from genome projects.

| Gene | Accession No. | GI No. | Organism |
| --- | --- | --- | --- |
| lysDH | AB052732 | 13429872 | *Geobacillus stearothermophilus* |
| lysDH | NP_147035.1 | 14602185 | *Aeropyrum pernix* K1 |
| ldh | P0A393 | 61222614 | *Bacillus cereus* |

2.3.1.a—Acyltransferase (Transferring Phosphate Group)

Exemplary phosphate transferring acyltransferases include phosphotransacetylase, encoded by pta, and phosphotransbutyrylase, encoded by ptb. The pta gene from *E. coli* encodes an enzyme that can convert acetyl-CoA into acetyl-phosphate, and vice versa (Suzuki, T. *Biochim. Biophys. Acta* 191:559-569 (1969)). This enzyme can also utilize propionyl-CoA instead of acetyl-CoA forming propionate in the process (Hesslinger et al. *Mol. Microbiol* 27:477-492 (1998)). Similarly, the ptb gene from *C. acetobutylicum* encodes an enzyme that can convert butyryl-CoA into butyryl-phosphate (Walter et al. *Gene* 134(1): p. 107-11 (1993)); Huang et al. *J Mol Microbiol Biotechnol* 2(1): p. 33-38 (2000). Additional ptb genes can be found in butyrate-producing bacterium L2-50 (Louis et al. *J. Bacteriol.* 186:2099-2106 (2004)) and *Bacillus megaterium* (Vazquez et al. *Curr. Microbiol* 42:345-349 (2001)).

| Gene | Accession No. | GI No. | Organism |
| --- | --- | --- | --- |
| pta | NP_416800.1 | 16130232 | *Escherichia coli* |
| ptb | NP_349676 | 15896327 | *Clostridium acetobutylicum* |
| ptb | AAR19757.1 | 38425288 | butyrate-producing bacterium L2-50 |
| ptb | CAC07932.1 | 10046659 | *Bacillus megaterium* |

2.6.1.a—Aminotransferase

Aspartate aminotransferase transfers an amino group from aspartate to alpha-ketoglutarate, forming glutamate and oxaloacetate. This conversion is catalyzed by, for example, the gene products of aspC from *Escherichia coli* (Yagi et al. *FEBS Lett.* 100:81-84 (1979); Yagi et al. *Methods Enzymol.* 113:83-89 (1985)), AAT2 from *Saccharomyces cerevisiae* (Yagi et al. *J Biochem.* 92:35-43 (1982)) and ASP5 from *Arabidopsis thaliana* (48, 108, 225 48. de la et al. *Plant J* 46:414-425 (2006); Kwok and Hanson *J Exp. Bot.* 55:595-604 (2004); Wilkie and Warren *Protein Expr. Purif.* 12:381-389 (1998)). Valine aminotransferase catalyzes the conversion of valine and pyruvate to 2-ketoisovalerate and alanine. The *E. coli* gene, avtA, encodes one such enzyme (Whalen and Berg *J. Bacteriol.* 150:739-746 (1982)). This gene product also catalyzes the amination of α-ketobutyrate to generate α-aminobutyrate, although the amine donor in this reaction has not been identified (Whalen and Berg *J. Bacteriol.* 158:571-574 (1984)). The gene product of the *E. coli* serC catalyzes two reactions, phosphoserine aminotransferase and phosphohydroxythreonine aminotransferase (Lam and Winkler *J. Bacteriol.* 172:6518-6528 (1990)), and activity on non-phosphorylated substrates could not be detected (Drewke et al. *FEBS. Lett.* 390:179-182 (1996)).

| Gene | Accession No. | GI No. | Organism |
| --- | --- | --- | --- |
| aspC | NP_415448.1 | 16128895 | *Escherichia coli* |
| AAT2 | P23542.3 | 1703040 | *Saccharomyces cerevisiae* |
| ASP5 | P46248.2 | 20532373 | *Arabidopsis thaliana* |
| avtA | YP_026231.1 | 49176374 | *Escherichia coli* |
| serC | NP_415427.1 | 16128874 | *Escherichia coli* |

Cargill has developed a beta-alanine/alpha-ketoglutarate aminotransferase for producing 3-HP from beta-alanine via malonyl-semialdehyde (PCT/US2007/076252 (Jessen et al)). The gene product of SkPYD4 in *Saccharomyces kluyveri* was also shown to preferentially use beta-alanine as the amino group donor (Andersen et al. *FEBS. J.* 274:1804-1817 (2007)). SkUGA1 encodes a homologue of *Saccharomyces cerevisiae* GABA aminotransferase, UGA1 (Ramos et al. *Eur. Biochem.* 149:401-404 (1985)), whereas SkPYD4 encodes an enzyme involved in both β-alanine and GABA transamination (Andersen et al. *FEBS. J.* 274:1804-1817 (2007)). 3-Amino-2-methylpropionate transaminase catalyzes the transformation from methylmalonate semialdehyde to 3-amino-2-methylpropionate. The enzyme has been characterized in *Rattus norvegicus* and *Sus scrofa* and is encoded by Abat (Kakimoto et al. *Biochim. Biophys. Acta* 156:374-380 (1968); Tamaki et al. *Methods Enzymol.* 324: 376-389 (2000)). Enzyme candidates in other organisms with high sequence homology to 3-amino-2-methylpropionate transaminase include Gta-1 in *C. elegans* and gabT in *Bacillus subtilis*. Additionally, one of the native GABA aminotransferases in *E. coli*, encoded by gene gabT, has been shown to have broad substrate specificity (Liu et al. *Biochemistry* 43:10896-10905 (2004); Schulz et al. *Appl Environ Microbiol* 56:1-6 (1990)). The gene product of puuE catalyzes the other 4-aminobutyrate transaminase in *E. coli* (Kurihara et al. *J. Biol. Chem.* 280:4602-4608 (2005)).

| Gene | Accession No. | GI No. | Organism |
| --- | --- | --- | --- |
| SkyPYD4 | ABF58893.1 | 98626772 | *Saccharomyces kluyveri* |
| SkUGA1 | ABF58894.1 | 98626792 | *Saccharomyces kluyveri* |
| UGA1 | NP_011533.1 | 6321456 | *Saccharomyces cerevisiae* |
| Abat | P50554.3 | 122065191 | *Rattus norvegicus* |
| Abat | P80147.2 | 120968 | *Sus scrofa* |
| Gta-1 | Q21217.1 | 6016091 | *Caenorhabditis elegans* |
| gabT | P94427.1 | 6016090 | *Bacillus subtilus* |
| gabT | P22256.1 | 120779 | *Escherichia coli* K12 |
| puuE | NP_415818.1 | 16129263 | *Escherichia coli* K12 |

The X-ray crystal structures of *E. coli* 4-aminobutyrate transaminase unbound and bound to the inhibitor were reported (Liu et al. *Biochemistry* 43:10896-10905 (2004)). The substrates binding and substrate specificities were studied and suggested. The roles of active site residues were studied by site-directed mutagenesis and X-ray crystallography (Liu et al. *Biochemistry* 44:2982-2992 (2005)). Based on the structural information, attempt was made to engineer *E. coli* 4-aminobutyrate transaminase with novel enzymatic activity. These studies provide a base for evolving transaminase activity for BDO pathways.

2.7.2.a—Phosphotransferase, Carboxyl Group Acceptor

Exemplary kinases include the *E. coli* acetate kinase, encoded by ackA (Skarstedt and Silverstein *J. Biol. Chem.* 251:6775-6783 (1976)), the *C. acetobutylicum* butyrate kinases, encoded by buk1 and buk2 (Walter et al. *Gene* 134(1):107-111 (1993) (Huang et al. *J Mol Microbiol Biotechnol* 2(1):33-38 (2000)], and the *E. coli* gamma-glutamyl kinase, encoded by proB (Smith et al. *J. Bacteriol.* 157:545-551 (1984)). These enzymes phosphorylate acetate, butyrate, and glutamate, respectively. The ackA gene product from *E. coli* also phosphorylates propionate (Hesslinger et al. *Mol. Microbiol* 27:477-492 (1998)).

| Gene | Accession No. | GI No. | Organism |
| --- | --- | --- | --- |
| ackA | NP_416799.1 | 16130231 | *Escherichia coli* |
| buk1 | NP_349675 | 15896326 | *Clostridium acetobutylicum* |
| buk2 | Q97II1 | 20137415 | *Clostridium acetobutylicum* |
| proB | NP_414777.1 | 16128228 | *Escherichia coli* |

2.8.3.a—Coenzyme-A Transferase

In the CoA-transferase family, *E. coli* enzyme acyl-CoA: acetate-CoA transferase, also known as acetate-CoA transferase (EC 2.8.3.8), has been shown to transfer the CoA moiety to acetate from a variety of branched and linear acyl-CoA substrates, including isobutyrate (Matthies and Schink *Appl Environ Microbiol* 58:1435-1439 (1992)), valerate (Vanderwinkel et al. *Biochem. Biophys. Res Commun.* 33:902-908 (1968)) and butanoate (Vanderwinkel, supra (1968)). This enzyme is encoded by atoA (alpha subunit) and atoD (beta subunit) in *E. coli* sp. K12 (Korolev et al. *Acta Crystallogr. D Biol Crystallogr.* 58:2116-2121 (2002); Vanderwinkel, supra (1968)) and actA and cg0592 in *Corynebacterium glutamicum* ATCC 13032 (Duncan et al. *Appl Environ Microbiol* 68:5186-5190 (2002)). Additional genes found by sequence homology include atoD and atoA in *Escherichia coli* UT189.

| Gene | Accession No. | GI No. | Organism |
| --- | --- | --- | --- |
| atoA | P76459.1 | 2492994 | *Escherichia coli* K12 |
| atoD | P76458.1 | 2492990 | *Escherichia coli* K12 |
| actA | YP_226809.1 | 62391407 | *Corynebacterium glutamicum* ATCC 13032 |
| cg0592 | YP_224801.1 | 62389399 | *Corynebacterium glutamicum* ATCC 13032 |
| atoA | ABE07971.1 | 91073090 | *Escherichia coli* UT189 |
| atoD | ABE07970.1 | 91073089 | *Escherichia coli* UT189 |

Similar transformations are catalyzed by the gene products of cat1, cat2, and cat3 of *Clostridium kluyveri* which have been shown to exhibit succinyl-CoA, 4-hydroxybutyryl-CoA, and butyryl-CoA acetyltransferase activity, respectively (Seedorf et al. *Proc Natl Acad Sci U.S.A.* 105(6):2128-2133 (2008); Sohling and Gottschalk *J. Bacteriol* 178(3):871-880 (1996)].

| Gene | Accession No. | GI No. | Organism |
| --- | --- | --- | --- |
| cat1 | P38946.1 | 729048 | *Clostridium kluyveri* |
| cat2 | P38942.2 | 1705614 | *Clostridium kluyveri* |
| cat3 | EDK35586.1 | 146349050 | *Clostridium kluyveri* |

The glutaconate-CoA-transferase (EC 2.8.3.12) enzyme from anaerobic bacterium *Acidaminococcus fermentans* reacts with diacid glutaconyl-CoA and 3-butenoyl-CoA (Mack and Buckel *FEBS Lett.* 405:209-212 (1997)). The genes encoding this enzyme are gctA and gctB. This enzyme has reduced but detectable activity with other CoA derivatives including glutaryl-CoA, 2-hydroxyglutaryl-CoA, adipyl-CoA and acrylyl-CoA (Buckel et al. *Eur. J. Biochem.* 118:315-321 (1981)). The enzyme has been cloned and expressed in *E. coli* (Mac et al. *Eur. J. Biochem.* 226:41-51 (1994)).

| Gene | Accession No. | GI No. | Organism |
|---|---|---|---|
| gctA | CAA57199.1 | 559392 | *Acidaminococcus fermentans* |
| gctB | CAA57200.1 | 559393 | *Acidaminococcus fermentans* |

3.1.2.a—Thiolester Hydrolase (CoA Specific)

In the CoA hydrolase family, the enzyme 3-hydroxyisobutyryl-CoA hydrolase is specific for 3-HIBCoA and has been described to efficiently catalyze the desired transformation during valine degradation (Shimomura et al. *J Biol Chem* 269:14248-14253 (1994)). Genes encoding this enzyme include hibch of *Rattus norvegicus* (Shimomura et al., supra (1994); Shimomura et al. *Methods Enzymol.* 324:229-240 (2000)) and *Homo sapiens* (Shimomura et al., supra, 2000). Candidate genes by sequence homology include hibch of *Saccharomyces cerevisiae* and BC 2292 of *Bacillus cereus*.

| Gene | Accession No. | GI No. | Organism |
|---|---|---|---|
| hibch | Q5XIE6.2 | 146324906 | *Rattus norvegicus* |
| hibch | Q6NVY1.2 | 146324905 | *Homo sapiens* |
| hibch | P28817.2 | 2506374 | *Saccharomyces cerevisiae* |
| BC_2292 | Q81DR3 | 81434808 | *Bacillus cereus* |

The conversion of adipyl-CoA to adipate can be carried out by an acyl-CoA hydrolase or equivalently a thioesterase. The top *E. coli* gene candidate is tesB (Naggert et al. *J Biol Chem.* 266(17):11044-11050 (1991)] which shows high similarity to the human acot8 which is a dicarboxylic acid acetyltransferase with activity on adipyl-CoA (Westin et al. *J Biol Chem* 280(46): 38125-38132 (2005). This activity has also been characterized in the rat liver (Deana, *Biochem Int.* 26(4): p. 767-773 (1992)).

| Gene | Accession No. | GI No. | Organism |
|---|---|---|---|
| tesB | NP_414986 | 16128437 | *Escherichia coli* |
| acot8 | CAA15502 | 3191970 | *Homo sapiens* |
| acot8 | NP_570112 | 51036669 | *Rattus norvegicus* |

Other potential *E. coli* thiolester hydrolases include the gene products of tesA (Bonner and Bloch, *J Biol Chem.* 247(10):3123-3133 (1972)), ybgC (Kuznetsova et al., *FEMS Microbiol Rev.* 29(2):263-279 (2005); Zhuang et al., *FEBS Lett.* 516(1-3):161-163 (2002)) paaI (Song et al., *J Biol Chem.* 281(16):11028-11038 (2006)), and ybdB (Leduc et al., *J Bacteriol.* 189(19):7112-7126 (2007)).

| Gene | Accession No. | GI No. | Organism |
|---|---|---|---|
| tesA | NP_415027 | 16128478 | *Escherichia coli* |
| ybgC | NP_415264 | 16128711 | *Escherichia coli* |
| paaI | NP_415914 | 16129357 | *Escherichia coli* |
| ybdB | NP_415129 | 16128580 | *Escherichia coli* |

Several eukaryotic acetyl-CoA hydrolases (EC 3.1.2.1) have broad substrate specificity. The enzyme from *Rattus norvegicus* brain (Robinson et al. *Biochem. Biophys. Res. Commun.* 71:959-965 (1976)) can react with butyryl-CoA, hexanoyl-CoA and malonyl-CoA.

| Gene | Accession No. | GI No. | Organism |
|---|---|---|---|
| acot12 | NP_570103.1 | 18543355 | *Rattus norvegicus* |

4.1.1.a—Carboxy-Lyase

An exemplary carboxy-lyase is acetolactate decarboxylase which participates in citrate catabolism and branched-chain amino acid biosynthesis, converting 2-acetolactate to acetoin. In *Lactococcus lactis* the enzyme is composed of six subunits, encoded by gene aldB, and is activated by valine, leucine and isoleucine (Goupil et al. *Appl. Environ Microbiol.* 62:2636-2640 (1996); Goupil-Feuillerat et al. *J. Bacteriol.* 182:5399-5408 (2000)). This enzyme has been overexpressed and characterized in *E. coli* (Phalip et al. *FEBS Lett.* 351:95-99 (1994)). In other organisms the enzyme is a dimer, encoded by aldC in *Streptococcus thermophilus* (Monnet et al. *Lett. Appl. Microbiol.* 36:399-405 (2003)), aldB in *Bacillus brevis* (Diderichsen et al. *J. Bacteriol.* 172:4315-4321 (1990); Najmudin et al. *Acta Crystallogr. D. Biol. Crystallogr.* 59:1073-1075 (2003)) and budA from *Enterobacter aerogenes* (Diderichsen et al. *J. Bacteriol.* 172:4315-4321 (1990)). The enzyme from *Bacillus brevis* was cloned and overexpressed in *Bacillus subtilis* and characterized crystallographically (Najmudin et al. *Acta Crystallogr. D. Biol. Crystallogr.* 59:1073-1075 (2003)). Additionally, the enzyme from *Leuconostoc lactis* has been purified and characterized but the gene has not been isolated (O'Sullivan et al. *FEMS Microbiol. Lett.* 194:245-249 (2001)).

| Gene | Accession No. | GI No. | Organism |
|---|---|---|---|
| aldB | NP_267384.1 | 15673210 | *Lactococcus lactis* |
| aldC | Q8L208 | 75401480 | *Streptococcus thermophilus* |
| aldB | P23616.1 | 113592 | *Bacillus brevis* |
| budA | P05361.1 | 113593 | *Enterobacter aerogenes* |

Aconitate decarboxylase catalyzes the final step in itaconate biosynthesis in a strain of *Candida* and also in the filamentous fungus *Aspergillus terreus* (Bonnarme et al. *J Bacteriol.* 177:3573-3578 (1995); Willke and Vorlop *Appl Microbiol Biotechnol* 56:289-295 (2001)). Although itaconate is a compound of biotechnological interest, the aconitate decarboxylase gene or protein sequence has not been reported to date.

4-oxalocronate decarboxylase has been isolated from numerous organisms and characterized. Genes encoding this enzyme include dmpH and dmpE in *Pseudomonas* sp. (strain 600) (Shingler et al. *J Bacteriol.* 174:711-724 (1992)), xylII and xylIII from *Pseudomonas putida* (Kato and Asano *Arch Microbiol* 168:457-463 (1997); Lian and Whitman *J. Am. Chem. Soc.* 116:10403-10411 (1994); Stanley et al. *Biochemistry* 39:3514 (2000)) and Reut_B5691 and Reut_B5692 from *Ralstonia eutropha* JMP134 (Hughes et al. *J. Bacteriol.* 158:79-83 (1984)). The genes encoding the enzyme from *Pseudomonas* sp. (strain 600) have been cloned and expressed in *E. coli* (Shingler et al. *J. Bacteriol.* 174:711-724 (1992)).

| Gene | Accession No. | GI No. | Organism |
|---|---|---|---|
| dmpH | CAA43228.1 | 45685 | *Pseudomonas* sp. CF600 |
| dmpE | CAA43225.1 | 45682 | *Pseudomonas* sp. CF600 |
| xylII | YP_709328.1 | 111116444 | *Pseudomonas putida* |

| Gene | Accession No. | GI No. | Organism |
| --- | --- | --- | --- |
| xylIII | YP_709353.1 | 111116469 | *Pseudomonas putida* |
| Reut_B5691 | YP_299880.1 | 73539513 | *Ralstonia eutropha* JMP134 |
| Reut_B5692 | YP_299881.1 | 73539514 | *Ralstonia eutropha* JMP134 |

An additional class of decarboxylases has been characterized that catalyze the conversion of cinnamate (phenylacrylate) and substituted cinnamate derivatives to the corresponding styrene derivatives. These enzymes are common in a variety of organisms and specific genes encoding these enzymes that have been cloned and expressed in *E. coli* are: pad 1 from *Saccharomyces cerevisae* (Clausen et al. *Gene* 142:107-112 (1994)), pdc from *Lactobacillus plantarum* (Barthelmebs et al. *Appl Environ Microbiol* 67:1063-1069 (2001); Qi et al. *Metab Eng* 9:268-276 (2007); Rodriguez et al. *J. Agric. Food Chem.* 56:3068-3072 (2008)), pofK (pad) from *Klebsiella oxytoca* (Hashidoko et al. *Biosci. Biotech. Biochem.* 58:217-218 (1994); Uchiyama et al. *Biosci. Biotechnol. Biochem.* 72:116-123 (2008)), *Pedicoccus pentosaceus* (Barthelmebs et al. *Appl Environ Microbiol* 67:1063-1069 (2001)), and padC from *Bacillus subtilis* and *Bacillus pumilus* (Lingen et al. *Protein Eng* 15:585-593 (2002)). A ferulic acid decarboxylase from *Pseudomonas fluorescens* also has been purified and characterized (Huang et al. *J. Bacteriol.* 176:5912-5918 (1994)). Importantly, this class of enzymes have been shown to be stable and do not require either exogenous or internally bound co-factors, thus making these enzymes ideally suitable for biotransformations (Sariaslani, *Annu. Rev. Microbiol.* 61:51-69 (2007)).

| Gene | Accession No. | GI No. | Organism |
| --- | --- | --- | --- |
| pad1 | AB368798 | 188496948 | *Saccharomyces cerevisae* |
| | BAG32372.1 | 188496949 | |
| pdc | U63827 | 1762615, 1762616 | *Lactobacillus plantarum* |
| | AAC45282.1 | | |
| pofK (pad) | AB330293, | 149941607, 149941608 | *Klebsiella oxytoca* |
| | BAF65031.1 | | |
| padC | AF017117 | 2394281, 2394282 | *Bacillus subtilis* |
| | AAC46254.1 | | |
| pad | AJ276891 | 11322456, 11322458 | *Pedicoccus pentosaceus* |
| | CAC16794.1 | | |
| pad | AJ278683 | 11691809, 11691810 | *Bacillus pumilus* |
| | CAC18719.1 | | |

Additional decarboxylase enzymes can form succinic semialdehyde from alpha-ketoglutarate. These include the alpha-ketoglutarate decarboxylase enzymes from *Euglena gracilis* (Shigeoka et al. *Biochem. J.* 282(Pt 2):319-323 (1992); Shigeoka and Nakano *Arch. Biochem. Biophys.* 288:22-28 (1991); Shigeoka and Nakano *Biochem. J.* 292 (Pt 2):463-467 (1993)), whose corresponding gene sequence has yet to be determined, and from *Mycobacterium tuberculosis* (Tian et al. *Proc Natl Acad Sci U.S.A.* 102:10670-10675 (2005)). In addition, glutamate decarboxylase enzymes can convert glutamate into 4-aminobutyrate such as the products of the *E. coli* gadA and gadB genes (De Biase et al. *Protein. Expr. Purif.* 8:430-438 (1993)).

| Gene | Accession No. | GI No. | Organism |
| --- | --- | --- | --- |
| kgd | O50463.4 | 160395583 | *Mycobacterium tuberculosis* |
| gadA | NP_417974 | 16131389 | *Escherichia coli* |
| gadB | NP_416010 | 16129452 | *Escherichia coli* |

Keto-Acid Decarboxylases

Pyruvate decarboxylase (PDC, EC 4.1.1.1), also termed keto-acid decarboxylase, is a key enzyme in alcoholic fermentation, catalyzing the decarboxylation of pyruvate to acetaldehyde. This enzyme has a broad substrate range for aliphatic 2-keto acids including 2-ketobutyrate, 2-ketovalerate, 3-hydroxypyruvate and 2-phenylpyruvate (Berg et al. *Science* 318:1782-1786 (2007)). The PDC from *Zymomonas mobilus*, encoded by pdc, has been a subject of directed engineering studies that altered the affinity for different substrates (Siegert et al. *Protein Eng Des Sel* 18:345-357 (2005)). The PDC from *Saccharomyces cerevisiae* has also been extensively studied, engineered for altered activity, and functionally expressed in *E. coli* (Killenberg-Jabs et al. *Eur. J. Biochem.* 268:1698-1704 (2001); Li and Jordan *Biochemistry* 38:10004-10012 (1999); ter Schure et al. *Appl. Environ. Microbiol.* 64:1303-1307 (1998)). The crystal structure of this enzyme is available (Killenberg-Jabs *Eur. J. Biochem.* 268:1698-1704 (2001)). Other well-characterized PDC candidates include the enzymes from *Acetobacter pasteurians* (Chandra et al. *Arch. Microbiol.* 176:443-451 (2001)) and *Kluyveromyces lactis* (Krieger et al. *Eur. J. Biochem.* 269:3256-3263 (2002)).

| Gene | Accession No. | GI No. | Organism |
| --- | --- | --- | --- |
| pdc | P06672.1 | 118391 | *Zymomonas mobilus* |
| pdc1 | P06169 | 30923172 | *Saccharomyces cerevisiae* |
| pdc | Q8L388 | 75401616 | *Acetobacter pasteurians* |
| pdc1 | Q12629 | 52788279 | *Kluyveromyces lactis* |

Like PDC, benzoylformate decarboxylase (EC 4.1.1.7) has a broad substrate range and has been the target of enzyme engineering studies. The enzyme from *Pseudomonas putida* has been extensively studied and crystal structures of this enzyme are available (Hasson et al. *Biochemistry* 37:9918-9930 (1998); Polovnikova et al. *Biochemistry* 42:1820-1830 (2003)). Site-directed mutagenesis of two residues in the active site of the *Pseudomonas putida* enzyme altered the affinity (Km) of naturally and non-naturally occurring substrates (Siegert *Protein Eng Des Sel* 18:345-357 (2005)). The properties of this enzyme have been further modified by directed engineering (Lingen et al. *Protein Eng* 15:585-593 (2002)); Lingen *Chembiochem* 4:721-726 (2003)). The enzyme from *Pseudomonas aeruginosa*, encoded by mdC, has also been characterized experimentally (Barrowman et al. *FEMS Microbiology Letters* 34:57-60 (1986)). Additional gene candidates from *Pseudomonas stutzeri, Pseudomonas fluorescens* and other organisms can be inferred by sequence homology or identified using a growth selection system developed in *Pseudomonas putida* (Henning et al. *Appl. Environ. Microbiol.* 72:7510-7517 (2006)).

| Gene | Accession No. | GI No. | Organism |
| --- | --- | --- | --- |
| mdlC | P20906.2 | 3915757 | *Pseudomonas putida* |
| mdlC | Q9HUR2.1 | 81539678 | *Pseudomonas aeruginosa* |
| dpgB | ABN80423.1 | 126202187 | *Pseudomonas stutzeri* |
| ilvB-1 | YP_260581.1 | 70730840 | *Pseudomonas fluorescens* |

4.2.1.a—Hydro-Lyase

The 2-(hydroxymethyl)glutarate dehydratase of *Eubacterium barkeri* is an exemplary hydro-lyase. This enzyme has been studied in the context of nicotinate catabolism and is encoded by hmd (Alhapel et al. *Proc Natl Acad Sci USA*

103:12341-12346 (2006)). Similar enzymes with high sequence homology are found in *Bacteroides capillosus, Anaerotruncus colihominis*, and *Natranaerobius thermophilius*.

| Gene | Accession No. | GI No. | Organism |
| --- | --- | --- | --- |
| hmd | ABC88407.1 | 86278275 | *Eubacterium barkeri* |
| BACCAP_02294 | ZP_02036683.1 | 154498305 | *Bacteroides capillosus* ATCC 29799 |
| ANACOL_02527 | ZP_02443222.1 | 167771169 | *Anaerotruncus colihominis* DSM 17241 |
| NtherDRAFT_2368 | ZP_02852366.1 | 169192667 | *Natranaerobius thermophilus* JW/NM-WN-LF |

A second exemplary hydro-lyase is fumarate hydratase, an enzyme catalyzing the dehydration of malate to fumarate. A wealth of structural information is available for this enzyme and researchers have successfully engineered the enzyme to alter activity, inhibition and localization (Weaver, T *Acta Crystallogr. D Biol Crystallogr.* 61:1395-1401 (2005)). Additional fumarate hydratases include those encoded by fumC from *Escherichia coli* (Estevez et al. *Protein Sci.* 11:1552-1557 (2002); Hong and Lee *Biotechnol. Bioprocess Eng.* 9:252-255 (2004); Rose and Weaver *Proc Natl Acad Sci USA* 101:3393-3397 (2004)), *Campylobacter jejuni* (Smith et al. *Int. J. Biochem. Cell Biol* 31:961-975 (1999)) and *Thermus thermophilus* (Mizobata et al. *Arch. Biochem. Biophys.* 355:49-55 (1998)), and fumH from *Rattus norvegicus* (Kobayashi et al. *J. Biochem.* 89:1923-1931(1981)). Similar enzymes with high sequence homology include fum1 from *Arabidopsis thaliana* and fumC from *Corynebacterium glutamicum*.

| Gene | Accession No. | GI No. | Organism |
| --- | --- | --- | --- |
| fumC | P05042.1 | 120601 | *Escherichia coli* K12 |
| fumC | O69294.1 | 9789756 | *Campylobacter jejuni* |
| fumC | P84127 | 75427690 | *Thermus thermophilus* |
| fumH | P14408.1 | 120605 | *Rattus norvegicus* |
| fum1 | P93033.2 | 39931311 | *Arabidopsis thaliana* |
| fumC | Q8NRN8.1 | 39931596 | *Corynebacterium glutamicum* |

Citramalate hydrolyase, also called 2-methylmalate dehydratase, converts 2-methylmalate to mesaconate. 2-Methylmalate dehydratase activity was detected in *Clostridium tetanomorphum, Morganella morganii, Citrobacter amalonaticus* in the context of the glutamate degradation VI pathway (Kato and Asano *Arch Microbiol* 168:457-463 (1997)); however the genes encoding this enzyme have not been sequenced to date.

The gene product of crt from *C. acetobutylicum* catalyzes the dehydration of 3-hydroxybutyryl-CoA to crotonyl-CoA (Atsumi et al. *Metab Eng.;* 29 (2007)); Boynton et al. *Journal of Bacteriology* 178:3015-3024 (1996)). The enoyl-CoA hydratases, phaA and phaB, of *P. putida* are believed to carry out the hydroxylation of double bonds during phenylacetate catabolism; (Olivera et al. *Proc Natl Acad Sci USA* 95(11):6419-6424 (1998)). The paaA and paaB from *P. fluorescens* catalyze analogous transformations (14 Olivera et al., supra, 1998). Lastly, a number of *Escherichia coli* genes have been shown to demonstrate enoyl-CoA hydratase functionality including maoC (Park and Lee *J. Bacteriol* 185(18):5391-5397 (2003)), paaF (Park and Lee *Biotechnol Bioeng.* 86(6):681-686 (2004a)); Park and Lee *Appl Biochem Biotechnol.* 113-116: 335-346 (2004b)); Ismail et al. *Eur. J Biochem* 270(14):p. 3047-3054 (2003), and paaG (Park and Lee, supra, 2004; Park and Lee supra, 2004b; Ismail et al., supra, 2003).

| Gene | Accession No. | GI No. | Organism |
| --- | --- | --- | --- |
| maoC | NP_415905.1 | 16129348 | *Escherichia coli* |
| paaF | NP_415911.1 | 16129354 | *Escherichia coli* |
| paaG | NP_415912.1 | 16129355 | *Escherichia coli* |
| crt | NP_349318.1 | 15895969 | *Clostridium acetobutylicum* |
| paaA | NP_745427.1 | 26990002 | *Pseudomonas putida* |
| paaB | NP_745426.1 | 26990001 | *Pseudomonas putida* |
| phaA | ABF82233.1 | 106636093 | *Pseudomonas fluorescens* |
| phaB | ABF82234.1 | 106636094 | *Pseudomonas fluorescens* |

The *E. coli* genes fadA and fadB encode a multienzyme complex that exhibits ketoacyl-CoA thiolase, 3-hydroxyacyl-CoA dehydrogenase, and enoyl-CoA hydratase activities (Yang et al. *Biochemistry* 30(27): p. 6788-6795 (1991); Yang et al. *J Biol Chem* 265(18): p. 10424-10429 (1990); Yang et al. *J. Biol Chem* 266(24): p. 16255 (1991); Nakahigashi and Inokuchi *Nucleic Acids Res* 18(16): p. 4937 (1990)). The fadI and fadJ genes encode similar functions and are naturally expressed only anaerobically (Campbell et al. *Mol Microbiol* 47(3): p. 793-805 (2003). A method for producing poly[(R)-3-hydroxybutyrate] in *E. coli* that involves activating fadB (by knocking out a negative regulator, fadR) and co-expressing a non-native ketothiolase (phaA from *Ralstonia eutropha*) has been described previously (Sato et al. *J Biosci Bioeng* 103(1): 38-44 (2007)). This work clearly demonstrates that a β-oxidation enzyme, in particular the gene product of fadB which encodes both 3-hydroxyacyl-CoA dehydrogenase and enoyl-CoA hydratase activities, can function as part of a pathway to produce longer chain molecules from acetyl-CoA precursors.

| Gene | Accession No. | GI No. | Organism |
| --- | --- | --- | --- |
| fadA | YP_026272.1 | 49176430 | *Escherichia coli* |
| fadB | NP_418288.1 | 16131692 | *Escherichia coli* |
| fadI | NP_416844.1 | 16130275 | *Escherichia coli* |
| fadJ | NP_416843.1 | 16130274 | *Escherichia coli* |
| fadR | NP_415705.1 | 16129150 | *Escherichia coli* |

4.3.1.a—Ammonia-Lyase

Aspartase (EC 4.3.1.1), catalyzing the deamination of aspartate to fumarate, is a widespread enzyme in microorganisms, and has been characterized extensively (Viola, R. E. *Adv. Enzymol. Relat Areas Mol. Biol* 74:295-341 (2000)). The crystal structure of the *E. coli* aspartase, encoded by aspA, has been solved (Shi et al. *Biochemistry* 36:9136-9144 (1997)). The *E. coli* enzyme has also been shown to react with alternate substrates aspartatephenylmethylester, asparagine, benzyl-aspartate and malate (Ma et al. *Ann N.Y. Acad Sci* 672:60-65 (1992)). In a separate study, directed evolution was employed on this enzyme to alter substrate specificity (Asano et al. *Biomol. Eng* 22:95-101 (2005)). Enzymes with aspartase functionality have also been characterized in *Haemophilus influenzae* (Sjostrom et al. *Biochim. Biophys. Acta* 1324:182-190 (1997)), *Pseudomonas fluorescens* (Takagi et al. *J. Biochem.* 96:545-552 (1984)), *Bacillus subtilus* (Sjostrom et al. *Biochim. Biophys. Acta* 1324:182-190 (1997)) and *Serratia marcescens* (Takagi and Kisumi *J Bacteriol.* 161:1-6 (1985)).

| Gene | Accession No. | GI No. | Organism |
| --- | --- | --- | --- |
| aspA | NP_418562 | 90111690 | Escherichia coli K12 subsp. MG 1655 |
| aspA | P44324.1 | 1168534 | Haemophilus influenzae |
| aspA | P07346.1 | 114273 | Pseudomonas fluorescens |
| ansB | P26899.1 | 114271 | Bacillus subtilus |
| aspA | P33109.1 | 416661 | Serratia marcescens |

3-methylaspartase (EC 4.3.1.2), also known as beta-methylaspartase or 3-methylaspartate ammonia-lyase, catalyzes the deamination of threo-3-methylasparatate to mesaconate. The 3-methylaspartase from *Clostridium tetanomorphum* has been cloned, functionally expressed in *E. coli*, and crystallized (Asuncion et al. *Acta Crystallogr. D Biol Crystallogr.* 57:731-733 (2001); Asuncion et al. *J Biol Chem.* 277:8306-8311 (2002); Botting et al. *Biochemistry* 27:2953-2955 (1988); Goda et al. *Biochemistry* 31:10747-10756 (1992). In *Citrobacter amalonaticus*, this enzyme is encoded by BAA28709 (Kato and Asano *Arch. Microbiol* 168:457-463 (1997)). 3-Methylaspartase has also been crystallized from *E. coli* YG1002 (Asano and Kato *FEMS Microbiol Lett.* 118:255-258 (1994)) although the protein sequence is not listed in public databases such as GenBank. Sequence homology can be used to identify additional candidate genes, including CTC_02563 in *C. tetani* and ECs0761 in *Escherichia coli* O157:H7.

| Gene | Accession No. | GI No. | Organism |
| --- | --- | --- | --- |
| MAL | AAB24070.1 | 259429 | Clostridium tetanomorphum |
| BAA28709 | BAA28709.1 | 3184397 | Citrobacter amalonaticus |
| CTC_02563 | NP_783085.1 | 28212141 | Clostridium tetani |
| ECs0761 | BAB34184.1 | 13360220 | Escherichia coli O157:H7 str. Sakai |

Ammonia-lyase enzyme candidates that form enoyl-CoA products include beta-alanyl-CoA ammonia-lyase (EC 4.3.1.6), which deaminates beta-alanyl-CoA, and 3-aminobutyryl-CoA ammonia-lyase (EC 4.3.1.14). Two beta-alanyl-CoA ammonia lyases have been identified and characterized in *Clostridium propionicum* (Herrmann et al. *FEBS J.* 272:813-821 (2005)). No other beta-alanyl-CoA ammonia lyases have been studied to date, but gene candidates can be identified by sequence similarity. One such candidate is MXAN_4385 in *Myxococcus xanthus*.

| Gene | Accession No. | GI No. | Organism |
| --- | --- | --- | --- |
| acl2 | CAG29275.1 | 47496504 | Clostridium propionicum |
| acl1 | CAG29274.1 | 47496502 | Clostridium propionicum |
| MXAN_4385 | YP_632558.1 | 108756898 | Myxococcus xanthus |

5.3.3.a—Isomerase

The 4-hydroxybutyryl-CoA dehydratases from both *Clostridium aminobutyrium* and *C. kluyveri* catalyze the reversible conversion of 4-hydroxybutyryl-CoA to crotonyl-CoA and posses an intrinsic vinylacetyl-CoA Δ-isomerase activity (Scherf and Buckel *Eur. J. Biochem.* 215:421-429 (1993); Scherf et al. *Arch. Microbiol* 161:239-245 (1994)). Both native enzymes were purified and characterized, including the N-terminal amino acid sequences (Scherf and Buckel, supra, 1993; Scherf et al., supra, 1994). The abfD genes from *C. aninobutyrium* and *C. kluyveri* match exactly with these N-terminal amino acid sequences, thus are encoding the 4-hydroxybutyryl-CoA dehydratases/vinylacetyl-CoA Δ-isomerase. In addition, the abfD gene from *Polphyromonas gingivalis* ATCC 33277 is identified through homology from genome projects.

| Gene | Accession No. | GI No. | Organism |
| --- | --- | --- | --- |
| abfD | YP_001396399.1 | 153955634 | Clostridium kluyveri DSM 555 |
| abfD | P55792 | 84028213 | Clostridium aminobutyricum |
| abfD | YP_001928843 | 188994591 | Porphyromonas gingivalis ATCC 33277 |

5.4.3.a—Aminomutase

Lysine 2,3-aminomutase (EC 5.4.3.2) is an exemplary aminomutase that converts lysine to (3S)-3,6-diaminohexanoate, shifting an amine group from the 2- to the 3-position. The enzyme is found in bacteria that ferment lysine to acetate and butyrate, including as *Fusobacterium nuleatum* (kamA) (Barker et al. *J. Bacteriol.* 152:201-207 (1982)) and *Clostridium subterminale* (kamA) (Chirpich et al. *J. Biol. Chem.* 245:1778-1789 (1970)). The enzyme from *Clostridium subterminale* has been crystallized (Lepore et al. *Proc. Natl. Acad. Sci. USA* 102:13819-13824 (2005)). An enzyme encoding this function is also encoded by yodO in *Bacillus subtilus* (Chen et al. *Biochem. J.* 348 Pt 3:539-549 (2000)). The enzyme utilizes pyridoxal 5'-phosphate as a cofactor, requires activation by S-Adenosylmethoionine, and is stereoselective, reacting with the only with L-lysine. The enzyme has not been shown to react with alternate substrates.

| Gene | Accession No. | GI No. | Organism |
| --- | --- | --- | --- |
| yodO | O34676.1 | 4033499 | Bacillus subtilus |
| kamA | Q9XBQ8.1 | 75423266 | Clostridium subterminale |
| kamA | Q8RHX4 | 81485301 | Fusobacterium nuleatum subsp. nuleatum |

A second aminomutase, beta-lysine 5,6-aminomutase (EC 5.4.3.3), catalyzes the next step of lysine fermentation to acetate and butyrate, which transforms (3S)-3,6-diaminohexanoate to (3S,5S)-3,5-diaminohexanoate, shifting a terminal amine group from the 6- to the 5-position. This enzyme also catalyzes the conversion of lysine to 2,5-diaminohexanoate and is also called lysine-5,6-aminomutase (EC 5.4.3.4). The enzyme has been crystallized in *Clostridium sticklandii* (kamD, kamE) (Berkovitch et al. *Proc. Natl. Acad. Sci. U.S.A* 101:15870-15875 (2004)). The enzyme from *Porphyromonas gingivalis* has also been characterized (Tang et al. *Biochemistry* 41:8767-8776 (2002)).

| Gene | Accession No. | GI No. | Organism |
| --- | --- | --- | --- |
| kamD | AAC79717.1 | 3928904 | Clostridium sticklandii |
| kamE | AAC79718.1 | 3928905 | Clostridium sticklandii |
| kamD | NC_002950.2 | 34539880, 34540809 | Porphyromonas gingivalis W83 |
| kamE | NC_002950.2 | 34539880, 34540810 | Porphyromonas gingivalis W83 |

Ornithine 4,5-aminomutase (EC 5.4.3.5) converts D-ornithine to 2,4-diaminopentanoate, also shifting a terminal amine to the adjacent carbon. The enzyme from *Clostridium sticklandii* is encoded by two genes, oraE and oraS, and has been cloned, sequenced and expressed in *E. coli* (Chen et al. *J. Biol. Chem.* 276:44744-44750 (2001)). This enzyme has not been characterized in other organisms to date.

| Gene | Accession No. | GI No. | Organism |
|------|---------------|--------|----------|
| oraE | AAK72502 | 17223685 | *Clostridium sticklandii* |
| oraS | AAK72501 | 17223684 | *Clostridium sticklandii* |

Tyrosine 2,3-aminomutase (EC 5.4.3.6) participates in tyrosine biosynthesis, reversibly converting tyrosine to 3-amino-3-(4-hdyroxyphenyl)propanoate by shifting an amine from the 2- to the 3-position. In *Streptomyces globisporus* the enzyme has also been shown to react with tyrosine derivatives (Christenson et al. *Biochemistry* 42:12708-12718 (2003)). Sequence information is not available.

Leucine 2,3-aminomutase (EC 5.4.3.7) converts L-leucine to beta-leucine during leucine degradation and biosynthesis. An assay for leucine 2,3-aminomutase detected activity in many organisms (Poston, J. M. *Methods Enzymol.* 166:130-135 (1988)) but genes encoding the enzyme have not been identified to date.

Cargill has developed a novel 2,3-aminomutase enzyme to convert L-alanine to β-alanine, thus creating a pathway from pyruvate to 3-HP in four biochemical steps (Liao et al., U.S. Publication No. 2005-0221466).

6.2.1.a—Acid-Thiol Ligase

An exemplary acid-thiol ligase is the gene products of sucCD of *E. coli* which together catalyze the formation of succinyl-CoA from succinate with the concaminant consumption of one ATP, a reaction which is reversible in vivo (Buck et al. *Biochemistry* 24(22): p. 6245-6252 (1985)). Additional exemplary CoA-ligases include the rat dicarboxylate-CoA ligase for which the sequence is yet uncharacterized (Vamecq et al. *Biochem J.* 230(3): p. 683-693 (1985)), either of the two characterized phenylacetate-CoA ligases from *P. chrysogenum* (Lamas-Maceiras et al. *Biochem J* 395(1):147-155 (2006); Wang et al. *Biochem Biophys Res Commun,* 360(2):453-458 (2007)), the phenylacetate-CoA ligase from *Pseudomonas putida* (Martinez-Blanco et al. *J Biol Chem.* 265(12):7084-7090 (1990)), and the 6-carboxyhexanoate-CoA ligase from *Bacillus subtilis* (Bower et al. *J Bacteriol* 178(14):4122-4130 (1996)).

| Gene | Accession No. | GI No. | Organism |
|------|---------------|--------|----------|
| sucC | NP_415256.1 | 16128703 | *Escherichia coli* |
| sucD | AAC73823.1 | 1786949 | *Escherichia coli* |
| phl | CAJ15517.1 | 77019264 | *Penicillium chrysogenum* |
| phlB | ABS19624.1 | 152002983 | *Penicillium chrysogenum* |
| paaF | AAC24333.2 | 22711873 | *Pseudomonas putida* |
| bioW | NP_390902.2 | 50812281 | *Bacillus subtilis* |

Example V

Exemplary BDO Pathway from Succinyl-CoA

This example describes exemplary BDO pathways from succinyl-CoA.

BDO pathways from succinyl-CoA are described herein and have been described previously (see U.S. application Ser. No. 12/049,256, filed Mar. 14, 2008, and PCT application serial No. US08/57168, filed Mar. 14, 2008, each of which is incorporated herein by reference). Additional pathways are shown in FIG. 8A. Enzymes of such exemplary BDO pathways are listed in Table 15, along with exemplary genes encoding these enzymes.

Briefly, succinyl-CoA can be converted to succinic semialdehyde by succinyl-CoA reductase (or succinate semialdehyde dehydrogenase) (EC 1.2.1.b). Succinate semialdehyde can be converted to 4-hydroxybutyrate by 4-hydroxybutyrate dehydrogenase (EC 1.1.1.a), as previously described. Alternatively, succinyl-CoA can be converted to 4-hydroxybutyrate by succinyl-CoA reductase (alcohol forming) (EC 1.1.1.c). 4-Hydroxybutyrate can be converted to 4-hydroxybutyryl-CoA by 4-hydroxybutyryl-CoA transferase (EC 2.8.3.a), as previously described, or by 4-hydroxybutyryl-CoA hydrolase (EC 3.1.2.a) or 4-hydroxybutyryl-CoA ligase (or 4-hydroxybutyryl-CoA synthetase) (EC 6.2.1.a). Alternatively, 4-hydroxybutyrate can be converted to 4-hydroxybutyryl-phosphate by 4-hydroxybutyrate kinase (EC 2.7.2.a), as previously described. 4-Hydroxybutyryl-phosphate can be converted to 4-hydroxybutyryl-CoA by phosphotrans-4-hydroxybutyrylase (EC 2.3.1.a), as previously described. Alternatively, 4-hydroxybutyryl-phosphate can be converted to 4-hydroxybutanal by 4-hydroxybutanal dehydrogenase (phosphorylating) (EC 1.2.1.d). 4-Hydroxybutyryl-CoA can be converted to 4-hydroxybutanal by 4-hydroxybutyryl-CoA reductase (or 4-hydroxybutanal dehydrogenase) (EC 1.2.1.b). Alternatively, 4-hydroxybutyryl-CoA can be converted to 1,4-butanediol by 4-hydroxybutyryl-CoA reductase (alcohol forming) (EC 1.1.1.c). 4-Hydroxybutanal can be converted to 1,4-butanediol by 1,4-butanediol dehydrogenase (EC 1.1.1.a), as previously described.

TABLE 15

BDO pathway from succinyl-CoA.

| FIG. | EC class | Desired substrate | Desired product | Enzyme name | Gene name | GenBank ID (if available) | Organism | Known Substrates |
|------|----------|-------------------|-----------------|-------------|-----------|---------------------------|----------|------------------|
| 8A | 1.2.1.b | succinyl-CoA | succinic semialdehyde | succinyl-CoA reductase (or succinate semialdehyde dehydrogenase) | sucD | P38947.1 | *Clostridium kluyveri* | succinyl-CoA |
| | | | | | sucD | NP_904963.1 | *Porphyromonas gingivalis* | succinyl-CoA |
| | | | | | Msed_0709 | YP_001190808.1 | *Metallosphaera sedula* | malonyl-CoA |

TABLE 15-continued

BDO pathway from succinyl-CoA.

| FIG. | EC class | Desired substrate | Desired product | Enzyme name | Gene name | GenBank ID (if available) | Organism | Known Substrates |
|---|---|---|---|---|---|---|---|---|
| 8A | 1.1.1.a | succinate semialdehyde | 4-hydroxy-butyrate | 4-hydroxybutyrate dehydrogenase | 4hbd | YP_726053.1 | Ralstonia eutropha H16 | 4-hydroxy-butyrate |
| | | | | | 4hbd | L21902.1 | Clostridium kluyveri DSM 555 | 4-hydroxy-butyrate |
| | | | | | 4hbd | Q94B07 | Arabidopsis thaliana | 4-hydroxy-butyrate |
| 8A | 1.1.1.c | succinyl-CoA | 4-hydroxy-butyrate | succinyl-CoA reductase (alcohol forming) | adhE2 | AAK09379.1 | Clostridium acetobutylicum | butanoyl-CoA |
| | | | | | mcr | AAS20429.1 | Chloroflexus aurantiacus | malonyl-CoA |
| | | | | | FAR | AAD38039.1 | Simmondsia chinensis | long chain acyl-CoA |
| 8A | 2.8.3.a | 4-hydroxy-butyrate | 4-hydroxy-butyryl-CoA | 4-hydroxy-butyryl-CoA transferase | cat1, cat2, cat3 | P38946.1, P38942.2, EDK35586.1 | Clostridium kluyveri | succinate, 4-hydroxybutyrate, butyrate |
| | | | | | gctA, gctB | CAA57199.1, CAA57200.1 | Acidaminococcus fermentans | glutarate |
| | | | | | atoA, atoD | P76459.1, P76458.1 | Escherichia coli | butanoate |
| 8A | 3.1.2.a | 4-hydroxy-butyrate | 4-hydroxy-butyryl-CoA | 4-hydroxy-butyryl-CoA hydrolase | tesB | NP_414986 | Escherichia coli | adipyl-CoA |
| | | | | | acot12 | NP_570103.1 | Rattus norvegicus | butyryl-CoA |
| | | | | | hibch | Q6NVY1.2 | Homo sapiens | 3-hydroxy-propanoyl-CoA |
| 8A | 6.2.1.a | 4-hydroxy-butyrate | 4-hydroxy-butyryl-CoA | 4-hydroxy-butyryl-CoA ligase (or 4-hydroxybutyryl-CoA synthetase) | sucCD | NP_415256.1, AAC73823.1 | Escherichia coli | succinate |
| | | | | | phl | CAJ15517.1 | Penicillium chrysogenum | phenylacetate |
| | | | | | bioW | NP_390902.2 | Bacillus subtilis | 6-carboxy-hexanoate |
| 8A | 2.7.2.a | 4-hydroxy-butyrate | 4-hydroxy-butyryl-phosphate | 4-hydroxy-butyrate kinase | ackA | NP_416799.1 | Escherichia coli | acetate, propionate |
| | | | | | buk1 | NP_349675 | Clostridium acetobutylicum | butyrate |
| | | | | | buk2 | Q97II1 | Clostridium acetobutylicum | butyrate |
| 8A | 2.3.1.a | 4-hydroxy-butyryl-phosphate | 4-hydroxy-butyryl-CoA | phosphotrans-4-hydroxybutyrylase | ptb | NP_349676 | Clostridium acetobutylicum | butyryl-phosphate |
| | | | | | ptb | AAR19757.1 | butyrate-producing bacterium L2-50 | butyryl-phosphate |
| | | | | | ptb | CAC07932.1 | Bacillus megaterium | butyryl-phosphate |
| 8A | 1.2.1.d | 4-hydroxy-butyryl-phosphate | 4-hydroxy-butanal | 4-hydroxybutanal dehydrogenase (phosphorylating) | asd | NP_417891.1 | Escherichia coli | L-4-aspartyl-phosphate |
| | | | | | proA | NP_414778.1 | Escherichia coli | L-glutamyl-5-phospate |
| | | | | | gapA | P0A9B2.2 | Escherichia coli | Glyceraldehyde-3-phosphate |
| 8A | 1.2.1.b | 4-hydroxy-butyryl-CoA | 4-hydroxy-butanal | 4-hydroxy-butyryl-CoA reductase (or 4-hydroxybutanal dehydrogenase) | sucD | P38947.1 | Clostridium kluyveri | succinyl-CoA |
| | | | | | sucD | NP_904963.1 | Porphyromonas gingivalis | succinyl-CoA |
| | | | | | Msed_0709 | YP_001190808.1 | Metallosphaera sedula | malonyl-CoA |
| 8A | 1.1.1.c | 4-hydroxy-butyryl-CoA | 1,4-butanediol | 4-hydroxy-butyryl-CoA reductase (alcohol forming) | adhE2 | AAK09379.1 | Clostridium acetobutylicum | butanoyl-CoA |
| | | | | | mcr | AAS20429.1 | Chloroflexus aurantiacus | malonyl-CoA |
| | | | | | FAR | AAD38039.1 | Simmondsia chinensis | long chain acyl-CoA |

TABLE 15-continued

BDO pathway from succinyl-CoA.

| FIG. | EC class | Desired substrate | Desired product | Enzyme name | Gene name | GenBank ID (if available) | Organism | Known Substrates |
|---|---|---|---|---|---|---|---|---|
| 8A | 1.1.1.a | 4-hydroxy-butanal | 1,4-butanediol | 1,4-butanediol dehydrogenase | ADH2 | NP_014032.1 | *Saccharymyces cerevisiae* | general |
| | | | | | yqhD | NP_417484.1 | *Escherichia coli* | >C3 |
| | | | | | 4hbd | L21902.1 | *Clostridium kluyveri* DSM 555 | Succinate semialdehyde |

Example VI

Additional Exemplary BDO Pathways from Alpha-Ketoglutarate

This example describes exemplary BDO pathways from alpha-ketoglutarate.

BDO pathways from succinyl-CoA are described herein and have been described previously (see U.S. application Ser. No. 12/049,256, filed Mar. 14, 2008 (US publication 20090075351) and PCT application serial No. US08/57168, filed Mar. 14, 2008 (WO/2008/115840), each of which is incorporated herein by reference). Additional pathways are shown in FIG. 8B. Enzymes of such exemplary BDO pathways are listed in Table 16, along with exemplary genes encoding these enzymes.

Briefly, alpha-ketoglutarate can be converted to succinic semialdehyde by alpha-ketoglutarate decarboxylase (EC 4.1.1.a), as previously described. Alternatively, alpha-ketoglutarate can be converted to glutamate by glutamate dehydrogenase (EC 1.4.1.a). 4-Aminobutyrate can be converted to succinic semialdehyde by 4-aminobutyrate oxidoreductase (deaminating) (EC 1.4.1.a) or 4-aminobutyrate transaminase (EC 2.6.1.a). Glutamate can be converted to 4-aminobutyrate by glutamate decarboxylase (EC 4.1.1.a). Succinate semialdehyde can be converted to 4-hydroxybutyrate by 4-hydroxybutyrate dehydrogenase (EC 1.1.1.a), as previously described. 4-Hydroxybutyrate can be converted to 4-hydroxybutyryl-CoA by 4-hydroxybutyryl-CoA transferase (EC 2.8.3.a), as previously described, or by 4-hydroxybutyryl-CoA hydrolase (EC 3.1.2.a), or 4-hydroxybutyryl-CoA ligase (or 4-hydroxybutyryl-CoA synthetase) (EC 6.2.1.a). 4-Hydroxybutyrate can be converted to 4-hydroxybutyryl-phosphate by 4-hydroxybutyrate kinase (EC 2.7.2.a). 4-Hydroxybutyryl-phosphate can be converted to 4-hydroxybutyryl-CoA by phosphotrans-4-hydroxybutyrylase (EC 2.3.1.a), as previously described. Alternatively, 4-hydroxybutyryl-phosphate can be converted to 4-hydroxybutanal by 4-hydroxybutanal dehydrogenase (phosphorylating) (EC 1.2.1.d). 4-Hydroxybutyryl-CoA can be converted to 4-hydroxybutanal by 4-hydroxybutyryl-CoA reductase (or 4-hydroxybutanal dehydrogenase) (EC 1.2.1.b), as previously described. 4-Hydroxybutyryl-CoA can be converted to 1,4-butanediol by 4-hydroxybutyryl-CoA reductase (alcohol forming) (EC 1.1.1.c). 4-Hydroxybutanal can be converted to 1,4-butanediol by 1,4-butanediol dehydrogenase (EC 1.1.1.a), as previously described.

TABLE 16

BDO pathway from alpha-ketoglutarate.

| FIG. | EC class | Desired substrate | Desired product | Enzyme name | Gene name | GenBank ID (if available) | Organism | Known Substrates |
|---|---|---|---|---|---|---|---|---|
| 8B | 4.1.1.a | alpha-ketoglutarate | succinic semialdehyde | alpha-ketoglutarate decarboxylase | kgd | O50463.4 | *Mycobacterium tuberculosis* | alpha-ketoglutarate |
| | | | | | gadA | NP_417974 | *Escherichia coli* | glutamate |
| | | | | | gadB | NP_416010 | *Escherichia coli* | glutamate |
| 8B | 1.4.1.a | alpha-ketoglutarate | glutamate | glutamate dehydrogenase | gdhA | P00370 | *Escherichia coli* | glutamate |
| | | | | | gdh | P96110.4 | *Thermotoga maritima* | glutamate |
| | | | | | gdhA1 | NP_279651.1 | *Halobacterium salinarum* | glutamate |
| 8B | 1.4.1.a | 4-aminobutyrate | succinic semialdehyde | 4-aminobutyrate oxidoreductase (deaminating) | lysDH | AB052732 | *Geobacillus stearothermophilus* | lysine |
| | | | | | lysDH | NP_147035.1 | *Aeropyrum pernix* K1 | lysine |
| | | | | | ldh | P0A393 | *Bacillus cereus* | leucine, isoleucine, valine, 2-aminobutanoate |
| 8B | 2.6.1.a | 4-aminobutyrate | succinic semialdehyde | 4-aminobutyrate transaminase | gabT | P22256.1 | *Escherichia coli* | 4-aminobutyrate |
| | | | | | puuE | NP_415818.1 | *Escherichia coli* | 4-aminobutyrate |
| | | | | | UGA1 | NP_011533.1 | *Saccharomyces cerevisiae* | 4-aminobutyrate |

TABLE 16-continued

BDO pathway from alpha-ketoglutarate.

| FIG. | EC class | Desired substrate | Desired product | Enzyme name | Gene name | GenBank ID (if available) | Organism | Known Substrates |
|---|---|---|---|---|---|---|---|---|
| 8B | 4.1.1.a | glutamate | 4-amino-butyrate | glutamate decarboxylase | gadA | NP_417974 | Escherichia coli | glutamate |
|  |  |  |  |  | gadB | NP_416010 | Escherichia coli | glutamate |
|  |  |  |  |  | kgd | O50463.4 | Mycobacterium tuberculosis | alpha-keto-glutarate |
| 8B | 1.1.1.a | succinate semialdehyde | 4-hydroxy-butyrate | 4-hydroxybutyrate dehydrogenase | 4hbd | YP_726053.1 | Ralstonia eutropha H16 | 4-hydroxy-butyrate |
|  |  |  |  |  | 4hbd | L21902.1 | Clostridium kluyveri DSM 555 | 4-hydroxy-butyrate |
|  |  |  |  |  | 4hbd | Q94B07 | Arabidopsis thaliana | 4-hydroxy-butyrate |
| 8B | 2.8.3.a | 4-hydroxy-butyrate | 4-hydroxy-butyryl-CoA | 4-hydroxybutyryl-CoA transferase | cat1, cat2, cat3 | P38946.1, P38942.2, EDK35586.1 | Clostridium kluyveri | succinate, 4-hydroxybutyrate, butyrate |
|  |  |  |  |  | gctA, gctB | CAA57199.1, CAA57200.1 | Acidaminococcus fermentans | glutarate |
|  |  |  |  |  | atoA, atoD | P76459.1, P76458.1 | Escherichia coli | butanoate |
| 8B | 3.1.2.a | 4-hydroxy-butyrate | 4-hydroxy-butyryl-CoA | 4-hydroxybutyryl-CoA hydrolase | tesB | NP_414986 | Escherichia coli | adipyl-CoA |
|  |  |  |  |  | acot12 | NP_570103.1 | Rattus norvegicus | butyryl-CoA |
|  |  |  |  |  | hibch | Q6NVY1.2 | Homo sapiens | 3-hydroxy-propanoyl-CoA |
| 8B | 6.2.1.a | 4-hydroxy-butyrate | 4-hydroxy-butyryl-CoA | 4-hydroxybutyryl-CoA ligase (or 4-hydroxybutyryl-CoA synthetase) | sucCD | NP_415256.1, AAC73823.1 | Escherichia coli | succinate |
|  |  |  |  |  | phl | CAJ15517.1 | Penicillium chrysogenum | phenylacetate |
|  |  |  |  |  | bioW | NP_390902.2 | Bacillus subtilis | 6-carboxy-hexanoate |
| 8B | 2.7.2.a | 4-hydroxy-butyrate | 4-hydroxy-butyryl-phosphate | 4-hydroxybutyrate kinase | ackA | NP_416799.1 | Escherichia coli | acetate, propionate |
|  |  |  |  |  | buk1 | NP_349675 | Clostridium acetobutylicum | butyrate |
|  |  |  |  |  | buk2 | Q97II1 | Clostridium acetobutylicum | butyrate |
| 8B | 2.3.1.a | 4-hydroxy-butyryl-phosphate | 4-hydroxy-butyryl-CoA | phosphotrans-4-hydroxybutyrylase | ptb | NP_349676 | Clostridium acetobutylicum | butyryl-phosphate |
|  |  |  |  |  | ptb | AAR19757.1 | butyrate-producing bacterium L2-50 | butyryl-phosphate |
|  |  |  |  |  | ptb | CAC07932.1 | Bacillus megaterium | butyryl-phosphate |
| 8B | 1.2.1.d | 4-hydroxy-butyryl-phosphate | 4-hydroxy-butanal | 4-hydroxybutanal dehydrogenase (phosphorylating) | asd | NP_417891.1 | Escherichia coli | L-4-aspartyl-phosphate |
|  |  |  |  |  | proA | NP_414778.1 | Escherichia coli | L-glutamyl-5-phospate |
|  |  |  |  |  | gapA | P0A9B2.2 | Escherichia coli | Glyceraldehyde-3-phosphate |
| 8B | 1.2.1.b | 4-hydroxy-butyryl-CoA | 4-hydroxy-butanal | 4-hydroxybutyryl-CoA reductase (or 4-hydroxybutanal dehydrogenase) | sucD | P38947.1 | Clostridium kluyveri | succinyl-CoA |
|  |  |  |  |  | sucD | NP_904963.1 | Porphyromonas gingivalis | succinyl-CoA |
|  |  |  |  |  | Msed_0709 | YP_001190808.1 | Metallosphaera sedula | malonyl-CoA |
| 8B | 1.1.1.c | 4-hydroxy-butyryl-CoA | 1,4-butanediol | 4-hydroxybutyryl-CoA reductase (alcohol forming) | adhE2 | AAK09379.1 | Clostridium acetobutylicum | butanoyl-CoA |
|  |  |  |  |  | mcr | AAS20429.1 | Chloroflexus aurantiacus | malonyl-CoA |
|  |  |  |  |  | FAR | AAD38039.1 | Simmondsia chinensis | long chain acyl-CoA |

TABLE 16-continued

BDO pathway from alpha-ketoglutarate.

| FIG. | EC class | Desired substrate | Desired product | Enzyme name | Gene name | GenBank ID (if available) | Organism | Known Substrates |
|---|---|---|---|---|---|---|---|---|
| 8B | 1.1.1.a | 4-hydroxy-butanal | 1,4-butanediol | 1,4-butanediol dehydrogenase | ADH2 | NP_014032.1 | *Saccharymyces cerevisiae* | general |
| | | | | | yqhD | NP_417484.1 | *Escherichia coli* | >C3 |
| | | | | | 4hbd | L21902.1 | *Clostridium kluyveri* DSM 555 | Succinate semialdehyde |

Example VII

BDO Pathways from 4-Aminobutyrate

Figure 9A:
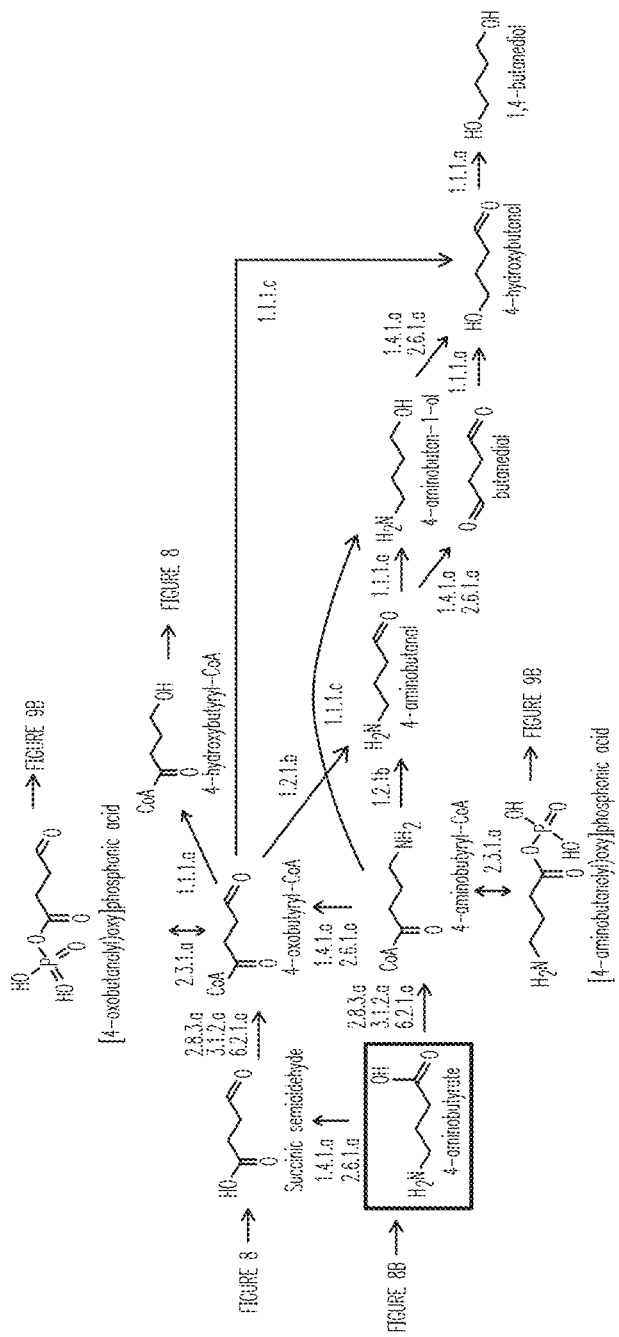
FIGS. 9A-9C show exemplary BDO pathways.
Figure 9B:
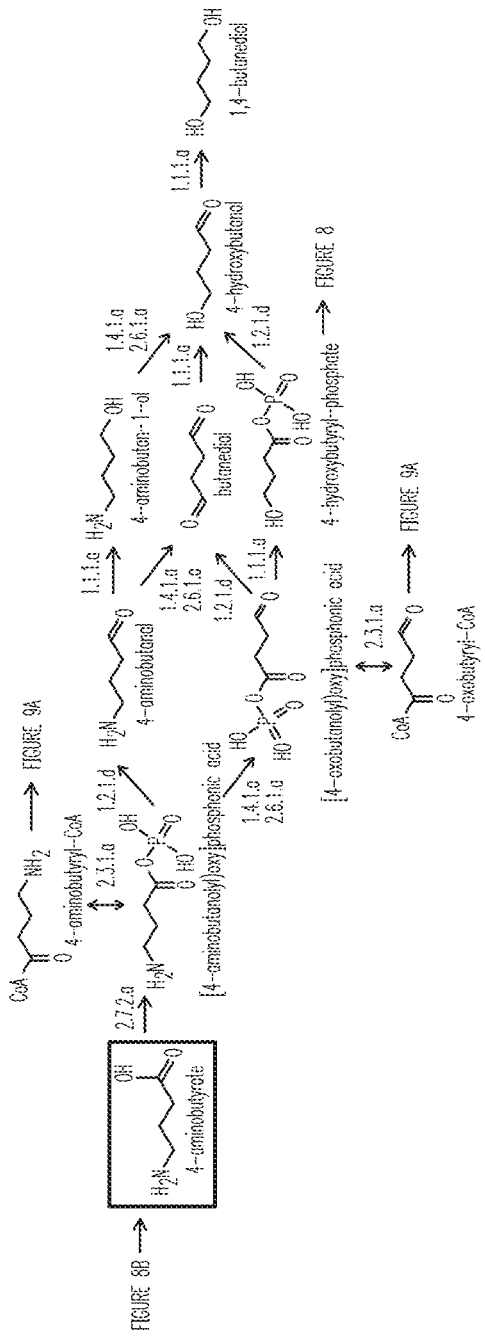
Figure 9C:
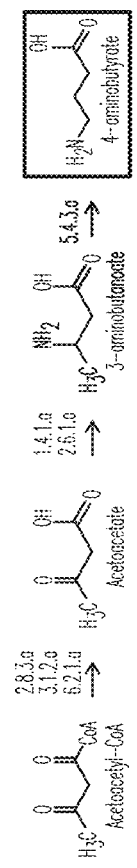
Figure 10:
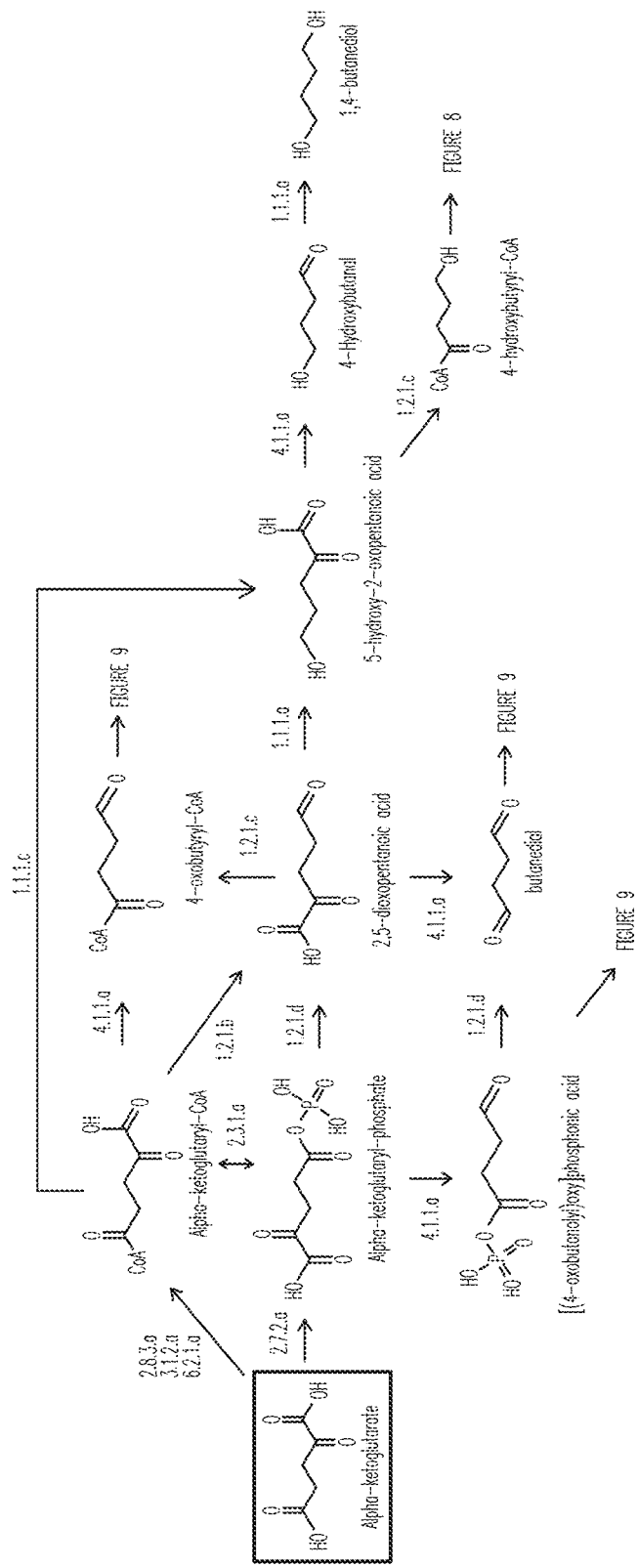
FIG. 10 shows exemplary BDO pathways from alpha-ketoglutarate.
Figure 13:
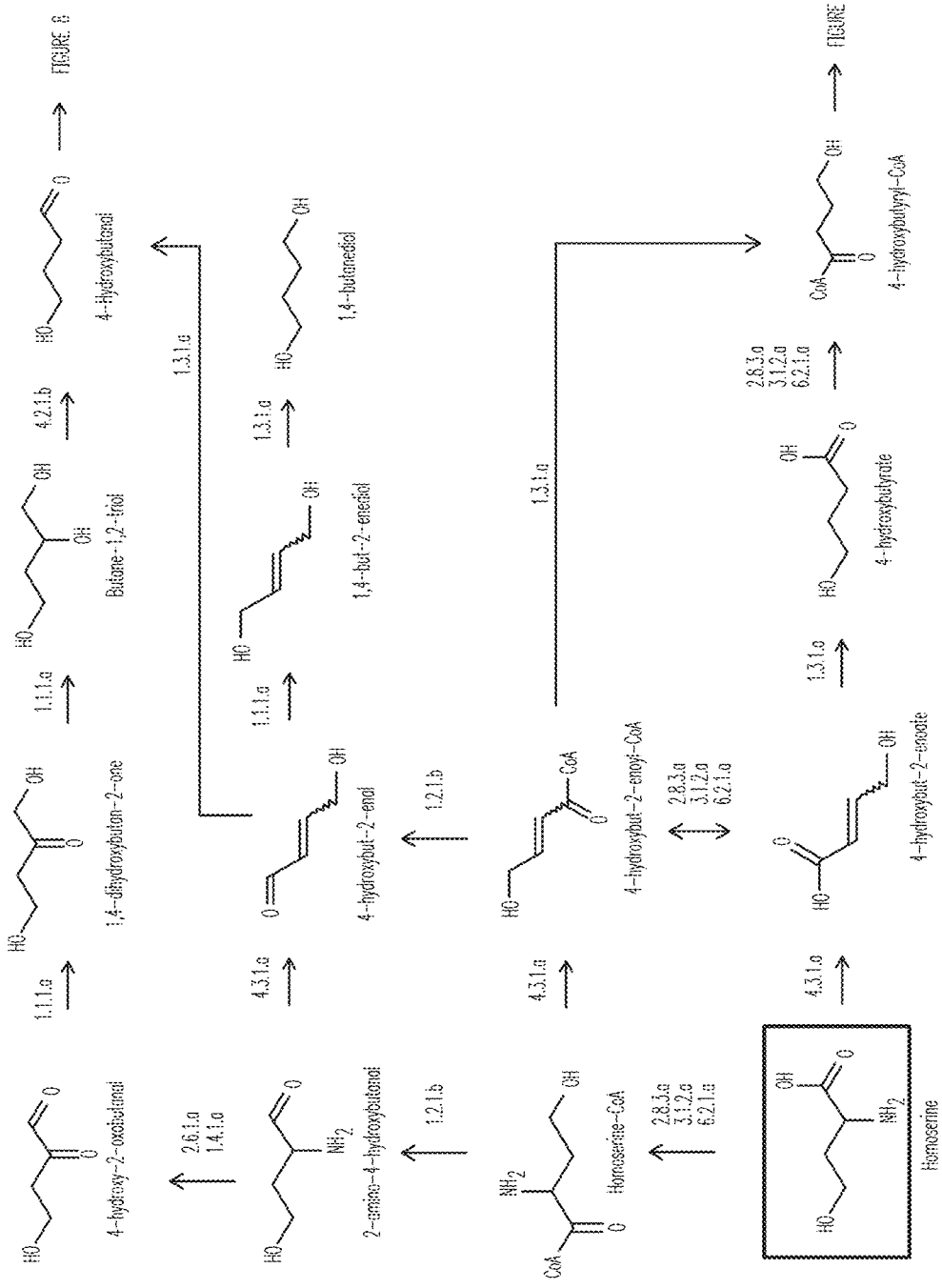
FIG. 13 shows exemplary BDO pathways from homoserine.

This example describes exemplary BDO pathway from 4-aminobutyrate. See corresponding Example in WO2013/184602 and FIGS. 9A and 9B. FIG. 9C shows an exemplary pathway through acetoacetate.

Example VIII

Exemplary BDO Pathways from Alpha-ketoglutarate

This example describes exemplary BDO pathways from alpha-ketoglutarate. See corresponding example in WO2013/186402 and FIG. 10.

Example IX

Exemplary BDO Pathways from Glutamate

This example describes exemplary BDO pathways from glutamate. See corresponding example in WO2013/186402 and FIG. 11.

Example X

Exemplary BDO from Acetoacetyl-CoA

This example describes an exemplary BDO pathway from acetoacetyl-CoA. See corresponding example in WO2013/186402 and FIG. 12.

Example XI

Exemplary BDO Pathway from Homoserine

This example describes an exemplary BDO pathway from homoserine. See corresponding example in WO2013/186402 and FIG. 13.

Example XII

BDO Producing Strains Expressing Succinyl-CoA Synthetase

This example describes increased production of BDO in BDO producing strains expressing succinyl-CoA synthetase. See corresponding example in WO2013/186402. The nucleotide sequence of the *E. coli* sucCD operon is shown in FIG. 14A, and the amino acid sequences for the encoded succinyl-CoA synthetase subunits are shown in FIGS. 14B and 14C.

The *E. coli* sucCD genes, which encode the succinyl-CoA synthetase, were overexpressed. The results showed that introducing into the strains sucCD to express succinyl-CoA synthetase improved BDO production in various strains compared to either native levels of expression or expression of cat1, which is a succinyl-CoA/acetyl-CoA transferase.

Thus, BDO production was improved by overexpressing the native *E. coli* sucCD genes encoding succinyl-CoA synthetase.

Example XIII

Expression of Heterologous Genes Encoding BDO Pathway Enzymes

This example describes the expression of various non-native pathway enzymes to provide improved production of BDO. See corresponding Example in WO2013/184602.

Alpha-Ketoglutarate Decarboxylase. The *Mycobacterium bovis* sucA gene encoding alpha-ketoglutarate decarboxylase was expressed in host strains. Overexpression of *M. bovis* sucA improved BDO production (see also WO2008/115840, WO 2009/023493, U.S. publication 2009/0047719, U.S. publication 2009/0075351). The nucleotide and amino acid sequences of *M. bovis* sucA and the encoded alpha-ketoglutarate decarboxylase are shown in FIG. 15.

To construct the *M. bovis* sucA expressing strains, fragments of the sucA gene encoding the alpha-ketoglutarate decarboxylase were amplified from the genomic DNA of *Mycobacterium bovis* BCG (ATCC 19015; American Type Culture Collection, Manassas VA) using primers shown below. The full-length gene was assembled by ligation reaction of the four amplified DNA fragments, and cloned into expression vectors pZS*13 and pZE23 behind the $P_{AllacO-1}$ promoter (Lutz and Bujard, *Nucleic Acids Res.* 25:1203-1210 (1997)). The nucleotide sequence of the assembled gene was verified by DNA sequencing.

```
Primers for fragment 1:
                                    (SEQ ID NO: 3)
5'-ATGTACCGCAAGTTCCGC-3';
                                    (SEQ ID NO: 4)
5'-CAATTTGCCGATGCCCAG-3'

Primers for fragment 2:
                                    (SEQ ID NO: 5)
5'-GCTGACCACTGAAGACTTTG-3';
                                    (SEQ ID NO: 6)
5'-GATCAGGGCTTCGGTGTAG-3'

Primers for fragment 3:
                                    (SEQ ID NO: 7)
5'-TTGGTGCGGGCCAAGCAGGATCTGCTC-3';
                                    (SEQ ID NO: 8)
5'-TCAGCCGAACGCCTCGTCGAGGATCTCCTG-3'

Primers for fragment 4:
                                    (SEQ ID NO: 9)
5'-TGGCCAACATAAGTTCACCATTCGGGCAAAC-3';
                                    (SEQ ID NO: 10)
5'-TCTCTTCAACCAGCCATTCGTTTTGCCCG-3'
```

Figure 16:
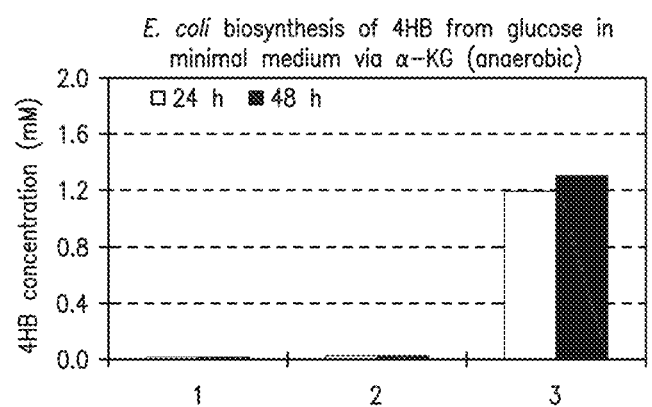
FIG. 16 shows biosynthesis in E. coli of 4-hydroxybutyrate from glucose in minimal medium via alpha-ketoglutarate under anaerobic (microaerobic) conditions. The host strain is ECKh-401. The experiments are labeled based on the upstream pathway genes present on the plasmid pZA33 as follows: 1) 4hbd-sucA; 2) sucCD-sucD-4hbd; 3) sucCD-sucD-4hbd-sucA.

Functional expression of the alpha-ketoglutarate decarboxylase was demonstrated using both in vitro and in vivo assays. The SucA enzyme activity was measured by following a previously reported method (Tian et al., *Proc. Natl. Acad Sci. USA* 102:10670-10675 (2005)). The reaction mixture contained 50 mM potassium phosphate buffer, pH 7.0, 0.2 mM thiamine pyrophosphate, 1 mM $MgCl_2$, 0.8 mM ferricyanide, 1 mM alpha-ketoglutarate and cell crude lysate. The enzyme activity was monitored by the reduction of ferricyanide at 430 nm. The in vivo function of the SucA enzyme was verified using *E. coli* whole-cell culture. Single colonies of *E. coli* MG1655 lacI$^q$ transformed with plasmids encoding the SucA enzyme and the 4-hydroxybutyrate dehydrogenase (4Hbd) was inoculated into 5 mL of LB medium containing appropriate antibiotics. The cells were cultured at 37° C. overnight aerobically. A200 uL of this overnight culture was introduced into 8 mL of M9 minimal medium (6.78 g/L $Na_2HPO_4$, 3.0 g/L $KH_2PO_4$, 0.5 g/L NaCl, 1.0 g/L $NH_4Cl$, 1 mM $MgSO_4$, 0.1 mM $CaCl_2$) supplemented with 20 g/L glucose, 100 mM 3-(N-morpholino)propanesulfonic acid (MOPS) to improve the buffering capacity, 10 µg/mL thiamine, and the appropriate antibiotics. Microaerobic conditions were established by initially flushing capped anaerobic bottles with nitrogen for 5 minutes, then piercing the septum with a 23G needle following inoculation. The needle was kept in the bottle during growth to allow a small amount of air to enter the bottles. The protein expression was induced with 0.2 mM isopropyl β-D-1-thiogalactopyranoside (IPTG) when the culture reached mid-log growth phase. As controls, *E. coli* MG1655 lacI$^q$ strains transformed with only the plasmid encoding the 4-hydroxybutyrate dehydrogenase and only the empty vectors were cultured under the same condition (see Table 17). The accumulation of 4-hydroxybutyrate (4HB) in the culture medium was monitored using LCMS method. Only the *E. coli* strain expressing the *Mycobacterium* alpha-ketoglutarate decarboxylase produced significant amount of 4HB (see FIG. 16).

TABLE 17

Three strains containing various plasmid controls and encoding sucA and 4-hydroxybutyrate dehydrogenase.

| | Host | pZE13 | pZA33 |
|---|---|---|---|
| 1 | MG1655 laclq | vector | vector |
| 2 | MG1655 laclq | vector | 4hbd |
| 3 | MG1655 laclq | sucA | 4hbd |

Figure 17:
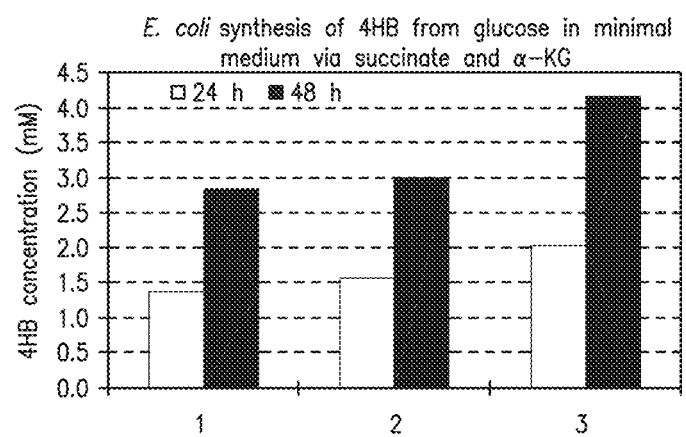
FIG. 17 shows biosynthesis in E. coli of 4-hydroxybutyrate from glucose in minimal medium via succinate and alpha-ketoglutarate. The host strain is wild-type MG1655. The experiments are labeled based on the genes present on the plasmids pZE13 and pZA33 as follows: 1) empty control vectors 2) empty pZE13, pZA33-4hbd; 3) pZE13-sucA, pZA33-4hbd.

A separate experiment demonstrated that the alpha-ketoglutarate decarboxylase pathway functions independently of the reductive TCA cycle. *E. coli* strain ECKh-401 (ΔadhE ΔldhA ΔpflB ΔlpdA::K.p.lpdA322 Δmdh ΔarcA) was used as the host strain. All the three constructs contained the gene encoding 4HB dehydrogenase (4Hbd). Construct 1 also contained the gene encoding the alpha-ketoglutarate decarboxylase (sucA). Construct 2 contained the genes encoding the succinyl-CoA synthetase (sucCD) and the CoA-dependent succinate semialdehyde dehydrogenase (sucD), which are required for the synthesis of 4HB via the reductive TCA cycle. Construct 3 contains all the genes from 1 and 2. The three *E. coli* strains were cultured under the same conditions as described above except the second culture was under the micro-aerobic condition. By expressing the SucA enzyme, construct 3 produced more 4HB than construct 2, which relies on the reductive TCA cycle for 4HB synthesis (see FIG. 17).

Succinate Semialdehyde Dehydrogenase (CoA-Dependent), 4-Hydroxybutyrate Dehydrogenase, and 4-Hydroxybutyryl-CoA/Acetyl-CoA Transferase. The genes from *Porphyromonas gingivalis* W83 can be effective components of the pathway for 1,4-butanediol production (see also WO2008/115840, WO 2009/023493, U.S. publication 2009/0047719, U.S. publication 2009/0075351). The nucleotide sequence of CoA-dependent succinate semialdehyde dehydrogenase (sucD) from *Porphyromonas gingivalis* is shown in FIG. 18A, and the encoded amino acid sequence is shown in FIG. 18B. The nucleotide sequence of 4-hydroxybutyrate dehydrogenase (4hbd) from *Porphymonas gingivalis* is shown in FIG. 19A, and the encoded amino acid sequence is shown in FIG. 19B. The nucleotide sequence of 4-hydroxybutyrate CoA transferase (cat2) from *Porphyromonas gingivalis* is shown in FIG. 20A, and the encoded amino acid sequence is shown in FIG. 20B.

Briefly, the genes from *Porphyromonas gingivalis* W83 encoding succinate semialdehyde dehydrogenase (CoA-dependent) and 4-hydroxybutyrate dehydrogenase, and in some cases additionally 4-hydroxybutyryl-CoA/acetyl-CoA, were cloned by PCR from *P. gingivalis* chromosomal DNA and introduced into multicopy plasmids pZS*13, pZA13, and pZE33 behind the PAllacO-1 promoter (Lutz and Bujard, *Nucleic Acids Res.* 25:1203-1210 (1997)) using standard molecular biology procedures. These plasmids were then introduced into host strains.

The *Porphyromonas gingivalis* W83 genes were introduced into production strains as described above. Some strains included only succinate semialdehyde dehydrogenase (CoA-dependant) and 4-hydroxybutyrate dehydrogenase without 4-hydroxybutyryl-CoA/acetyl-CoA transferase.

Butyrate Kinase and Phosphotransbutyrylase. utyrate kinase (BK) and phosphotransbutyrylase (PTB) enzymes can be utilized to produce 4-hydroxybutyryl-CoA (see also WO2008/115840, WO 2009/023493, U.S. publication 2009/0047719, U.S. publication 2009/0075351). In particular, the *Clostridium acetobuylicum* genes, buk1 and ptb, can be utilized as part of a functional BDO pathway.

Initial experiments involved the cloning and expression of the native *C. acetobutylicum* PTB (020) and BK (021) genes in *E. coli*. Where required, the start codon and stop codon for each gene were modified to "ATG" and "TAA," respectively, for more optimal expression in *E. coli*. The *C. acetobutylicum* gene sequences (020N and 021N) and their corresponding translated peptide sequences are shown in FIGS. 21 and 22.

The PTB and BK genes exist in *C. acetobutylicum* as an operon, with the PTB (020) gene expressed first. The two genes are connected by the sequence "atta aagttaagtg gaggaatgtt aac" (SEQ ID NO: 11) that includes a re-initiation ribosomal binding site for the downstream BK (021) gene. The two genes in this context were fused to lac-controlled promoters in expression vectors for expression in *E. coli* (Lutz and Bujard, *Nucleic Acids Res.* 25:1203-1210 (1997)).

Expression of the two proteins from these vector constructs was found to be low in comparison with other exogenously expressed genes due to the high incidence of codons in the *C. acetobutylicum* genes that occur only rarely in *E. coli*. Therefore new 020 and 021 genes were predicted that changed rare codons for alternates that are more highly represented in *E. coli* gene sequences. This method of codon optimization followed algorithms described previously (Sivaraman et al., *Nucleic Acids Res.* 36:e16(2008)). This method predicts codon replacements in context with their frequency of occurrence when flanked by certain codons on either side. Alternative gene sequences for 020 (FIG. 23) and 021 (FIG. 24) were determined in which increasing numbers of rare codons were replaced by more prevalent codons (A<B<C<D) based on their incidence in the neighboring codon context. No changes in actual peptide sequence compared to the native 020 and 021 peptide sequences were introduced in these predicted sequences.

Figure 25A:
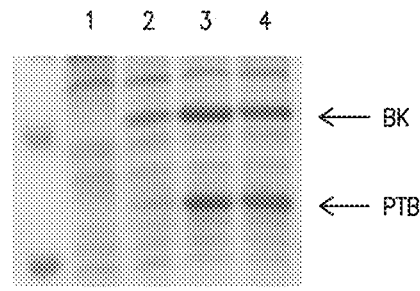
FIGS. 25A and 25B show improved expression of butyrate kinase (BK) and phosphotransbutyrylase (PTB) with optimized codons for expression in E. coli.
Figure 25B:
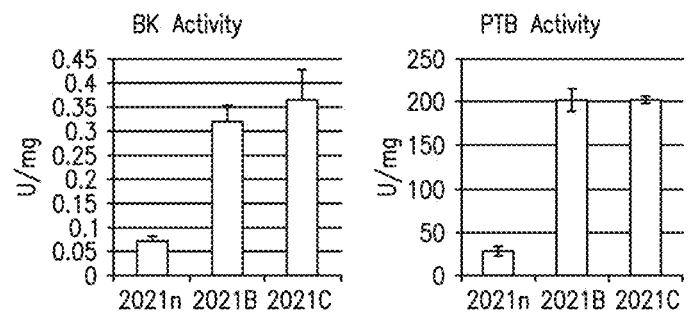

The improvement in expression of the BK and PTB proteins resulting from codon optimization is shown in FIG. 25A. Expression of the native gene sequences is shown in lane 2, while expression of the 020B-021B and 020C-021C is shown in lanes 3 and 4, respectively. Higher levels of protein expression in the codon-optimized operons 020B-021B (2021B) and 020C-021C (2021C) also resulted in increased activity compared to the native operon (2021n) in equivalently-expressed E. coli crude extracts (FIG. 25B).

Figure 26:
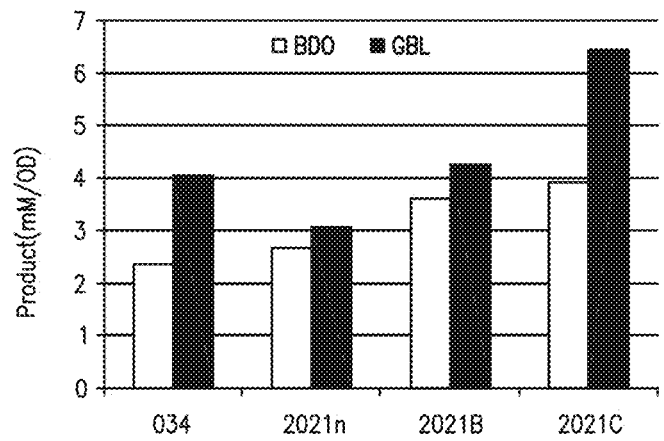
FIG. 26 shows production of BDO and gamma-butyrylactone (GBL) in various strains expressing BDO producing enzymes: Cat2 (034); 2021n; 2021B; 2021C.

The codon optimized operons were expressed on a plasmid in strain ECKh-432 (ΔadhE ΔldhA ΔpflB ΔlpdA::K.p.lpdA322 Δmdh ΔarcA gltAR163L fimD::E. coli sucCD, P. gingivalis sucD, P. gingivalis 4hbd fimD::M. bovis sucA, C. kluyveri 4hbd) along with the C. acetobutylicum aldehyde dehydrogenase to provide a complete BDO pathway. Cells were cultured in M9 minimal medium containing 20 g/L glucose, using a 23G needle to maintain microaerobic conditions as described above. The resulting conversion of glucose to the final product BDO was measured. Also measured was the accumulation of gamma-butyrylactone (GBL), which is a spontaneously rearranged molecule derived from 4Hb-CoA, the immediate product of the PTB-BK enzyme pair. FIG. 26 shows that expression of the native 2021n operon resulted in comparable BDO levels to an alternative enzyme function, Cat2 (034), that is capable of converting 4HB and free CoA to 4HB-CoA. GBL levels of 034 were significantly higher than 2021n, suggesting that the former enzyme has more activity than PTB-BK expressed from the native genes. However levels of both BDO and GBL were higher than either 034 or 2021n when the codon-optimized variants 2021B and 2021C were expressed, indicating that codon optimization of the genes for PTB and BK significantly increases their contributions to BDO synthesis in E. coli.

These results demonstrate that butyrate kinase (BK) and phosphotransbutyrylase (PTB) enzymes can be employed to convert 4-hydroxybutyrate to 4-hydroxybutyryl-CoA. This eliminates the need for a transferase enzyme such as 4-hydoxybutyryl-CoA/Acetyl-CoA transferase, which would generate one mole of acetate per mol of 4-hydroxybutyryl-CoA produced. The enzymes from Clostridium acetobuylicum are present in a number of engineered strains for BDO production.

4-Hydroxybutyryl-CoA Reductase. The Clostridium beijerinckii aldgene can be utilized as part of a functional BDO pathway (see also WO2008/115840, WO 2009/023493, U.S. publication 2009/0047719, U.S. publication 2009/0075351). The Clostridium beijerinckii ald can also be utilized to lower ethanol production in BDO producing strains. Additionally, a specific codon-optimized ald variant (GNM0025B) was found to improve BDO production.

Figure 29:
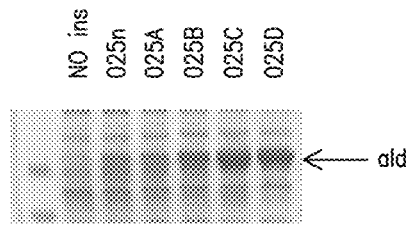
FIG. 29 shows expression of native C. beijerinckii ald gene and codon optimized variants; no ins (control with no insert), 025n, 025A, 025B, 025C, 025D.
Figure 30A:
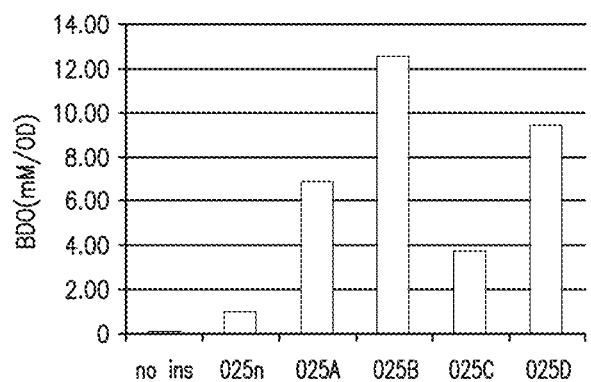
FIGS. 30A-30B show BDO or BDO and ethanol production in various strains.

The native C. beijerinckii ad gene (025n) and the predicted protein sequence of the enzyme are shown in FIG. 27. As was seen for the Clostridium acetobutylicum PTB and BK genes, expression of the native C. beijerinckii aldgene was very low in E. coli. Therefore, four codon-optimized variants for this gene were predicted. FIGS. 28A-28D show alternative gene sequences for 025, in which increasing numbers of rare codons are replaced by more prevalent codons (A<B<C<D) based on their incidence in the neighboring codon context (25A, P=0.05; 25B, P=0.1; 25C, P=0.15; 25D, P=1). No changes in actual peptide sequence compared to the native 025 peptide sequence were introduced in these predictions. Codon optimization significantly increased expression of the C. beijerinckii ald (see FIG. 29), which resulted in significantly higher conversion of glucose to BDO in cells expressing the entire BDO pathway (FIG. 30A).

Figure 30B:
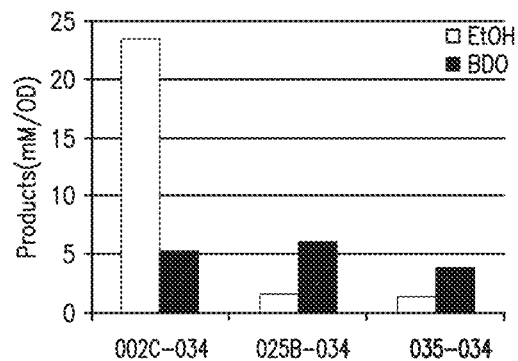

The native and codon-optimized genes were expressed on a plasmid along with P. gingivalis Cat2, in the host strain ECKh-432 (ΔadhE ΔldhA ΔpflB ΔlpdA::K.p.lpdA322 Δmdh ΔarcA gltAR163L ΔackA fimD:: E. coli sucCD, P. gingivalis sucD, P. gingivalis 4hbd fimD:: M. bovis sucA, C. kluyveri 4hbd), thus containing a complete BDO pathway. Cells were cultured microaerobically in M9 minimal medium containing 20 g/L glucose as described above. The relative production of BDO and ethanol by the C. beijerinckii Ald enzyme (expressed from codon-optimized variant gene 025B) was compared with the C. acetobutylicum AdhE2 enzyme (see FIG. 30B). The C. acetobutylicum AdhE2 enzyme (002C) produced nearly 4 times more ethanol than BDO. In comparison, the C. beijerinckii Aid (025B) (in conjunction with an endogenous ADH activity) produced equivalent amounts of BDO, yet the ratio of BDO to ethanol production was reversed for this enzyme compared to 002C. This suggests that the C. beijerinckii Aid is more specific for 4HB-CoA over acetyl-coA than the C. acetobutylicum AdhE2, and therefore the former is the preferred enzyme for inclusion in the BDO pathway.

The Clostridium beijerinckii aldgene (Toth et al., Appl. Environ. Microbiol. 65:4973-4980 (1999)) was tested as a candidate for catalyzing the conversion of 4-hydroxybutyryl-CoA to 4-hydroxybutanal. Over fifty aldehyde dehydrogenases were screened for their ability to catalyze the conversion of 4-hydroxybutyryl-CoA to 4-hydroxybutyraldehyde. The C. beijerinckii ald gene was chosen for implementation into BDO-producing strains due to the preference of this enzyme for 4-hydroxybutyryl-CoA as a substrate as opposed to acetyl-CoA. This is important because most other enzymes with aldehyde dehydrogenase functionality (for example, adhE2 from C. acetobuylicum (Fontaine et al., J. Bacteriol. 184:821-830 (2002)) preferentially convert acetyl-CoA to acetaldehyde, which in turn is converted to ethanol. Utilization of the C. beijerinckii gene lowers the amount of ethanol produced as a byproduct in BDO-producing organisms. Also, a codon-optimized version of this gene expresses very well in E. coli (Sivaraman et al., Nucleic Acids Res. 36:e16 (2008)).

4-Hydroxybutanal Reductase. 4-hydroxybutanal reductase activity of adh1 from Geobacillus thermoglucosidasius (M10EXG) was utilized. This led to improved BDO production by increasing 4-hydroxybutanal reductase activity over endogenous levels.

Multiple alcohol dehydrogenases were screened for their ability to catalyze the reduction of 4-hydroxybutanal to BDO. Most alcohol dehydrogenases with high activity on butyraldehyde exhibited far lower activity on 4-hydroxybutyraldehyde. One notable exception is the adh1 gene from Geobacillus thermoglucosidasius M10EXG (Jeon et al., J. Biotechnol. 135:127-133 (2008)) (GNM0084), which exhibits high activity on both 4-hydroxybutanal and butanal.

The native gene sequence and encoded protein sequence if the adh1 gene from Geobacillus thermoglucosidasius are shown in FIG. 31. The G. thermoglucosidasius ald1 gene was expressed in E. coli.

Figures 32A, 32B:
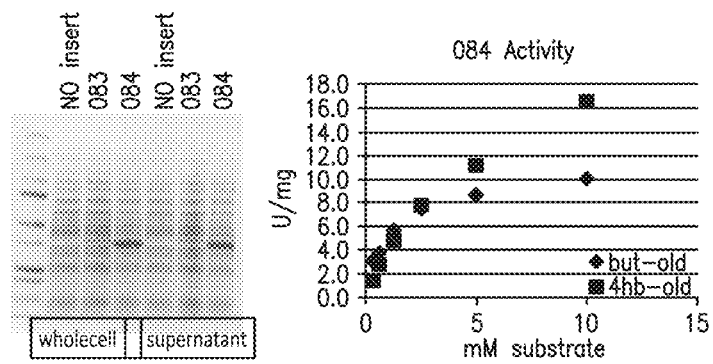
FIG. 32A shows the expression of the *Geobacillus thermoglucosidasius* adh1 gene in *E. coli*. Either whole cell lysates or supernatants were analyzed by SDS-PAGE and stained with Coomassie blue for plasmid with no insert, plasmid with 083 (*Geotrichum capitatum* N-benzyl-3-pyrrolidinol dehydrogenase) and plasmid with 084 (*Geobacillus thermoglucosidasius* adh1) inserts.
FIG. 32B shows the activity of 084 with butyraldehyde (diamonds) or 4-hydroxybutyraldehyde (squares) as substrates.

The Adh1 enzyme (084) expressed very well from its native gene in E. coli (see FIG. 32A). In ADH enzyme assays, the E. coli expressed enzyme showed very high reductive activity when butyraldehyde or 4HB-aldehyde were used as the substrates (see FIG. 32B). The Km values determined for these substrates were 1.2 mM and 4.0 mM, respectively. These activity values showed that the Adh1 enzyme was the most active on reduction of 4HB-aldehyde of all the candidates tested.

Figure 33:
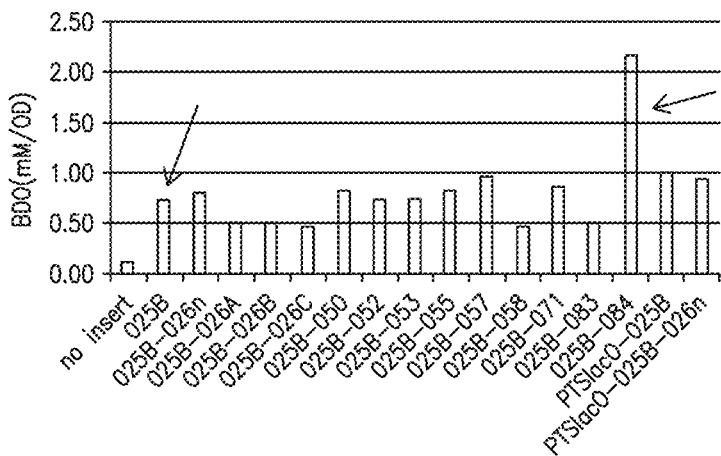
FIG. 33 shows the production of BDO in various strains: plasmid with no insert; 025B, 025B-026n; 025B-026A; 025B-026B; 025B-026C; 025B-050; 025B-052; 025B-053; 025B-055; 025B-057; 025B-058; 025B-071; 025B-083; 025B-084; PTSlacO-025B; PTSlacO-025B-026n.

The 084 enzyme was tested for its ability to boost BDO production when coupled with the C. beijerinckii ald. The 084 gene was inserted behind the C. beijerinckii ald variant 025B gene to create a synthetic operon that results in coupled expression of both genes. Similar constructs linked 025B with other ADH candidate genes, and the effect of including each ADH with 025B on BDO production was tested. The host strain used was ECKh-459 (ΔadhE ldhA ΔpflB ΔlpdA::fnr-pflB6-K.p.lpdA322 Δmdh ΔarcA gltAR163L fimD:: E. coli sucCD, P. gingivalis sucD, P. gingivalis 4hbd fimD:: M. bovis sucA, C. kluyveri 4hbd fimD::C. acetobuylicum buk1, C. acetobutylicum ptb), which contains the remainder of the BDO pathway on the chromosome. The 084 ADH expressed in conjunction with 025B showed the highest amount of BDO (right arrow in FIG. 33) when compared with 025B only (left arrow in FIG. 33) and in conjunction with endogenous ADH functions. It also produced more BDO than did other ADH enzymes when paired with 025B, indicated as follows: 026A-C, codon-optimized variants of Clostridium acetobutylicum butanol dehydrogenase; 050, Zymomonas mobilis alcohol dehydrogenase I; 052, Citrobacter freundii 1,3-propanediol dehydrogenase; 053, Lactobacillus brevis 1,3-propanediol dehydrogenase; 057, Bacteroides fragilis lactaldehyde reductase; 058, E. coli 1,3-propanediol dehydrogenase; 071, Bacillus subtilis 168 alpha-ketoglutarate semialdehyde dehydrogenase. The constructs labeled "PT5lacO" are those in which the genes are driven by the PT5lacO promoter. In all other cases, the PAllacO-1 promoter was used. This shows that inclusion of the 084 ADH in the BDO pathway increased BDO production.

Example XIV

BDO Producing Strains Expressing Pyruvate Dehydrogenase

This example describes the utilization of pyruvate dehydrogenase (PDH) to enhance BDO production. Heterologous expression of the Klebsiella pneumonia lpdA gene was used to enhance BDO production. See corresponding example in WO2013/186402.

PDH is one of the most complicated enzymes of central metabolism and is comprised of 24 copies of pyruvate decarboxylase (E1) and 12 molecules of dihydrolipoyl dehydrogenase (E3), which bind to the outside of the dihydrolipoyl transacetylase (E2) core. PDH is inhibited by high NADH/NAD, ATP/ADP, and Acetyl-CoA/CoA ratios. The enzyme naturally exhibits very low activity under oxygen-limited or anaerobic conditions in organisms such as E. coli due in large part to the NADH sensitivity of E3, encoded by lpdA. To this end, an NADH-insensitive version of the lpdA gene from Klebsiella pneumonia was cloned and expressed to increase the activity of PDH under conditions where the NADH/NAD ratio is expected to be high.

Replacement of the Native lpdA. The pyruvate dehydrogenase operon of Klebsiella pneumoniae is between 78 and 95% identical at the nucleotide level to the equivalent operon of E. coli. It was shown previously that K. pneumoniae has the ability to grow anaerobically in presence of glycerol (Menzel et al., J. Biotechnol. 56:135-142 (1997); Menzel et al., Biotechnol. Bioeng. 60:617-626 (1998)). It has also been shown that two mutations in the lpdA gene of the operon of E. coli would increase its ability to grow anaerobically (Kim et al., Appl. Environ. Microbiol. 73:1766-1771 (2007); Kim et al., J. Bacteriol. 190:3851-3858 (2008)). The lpdA gene of K. pneumonia was amplified by PCR using genomic DNA (ATCC700721D) as template and the primers KP-lpdA-Bam (5'-acacgcggatccaacgtcccgg-3')(SEQ ID NO: 12) and KP-lpdA-Nhe (5'-agcggctccgctagccgcttatg-3')(SEQ ID NO: 13). The resulting fragment was cloned into the vector pCR-BluntII-TOPO (Invitrogen; Carlsbad CA), leading to plasmid pCR-KP-lpdA.

Figure 34:
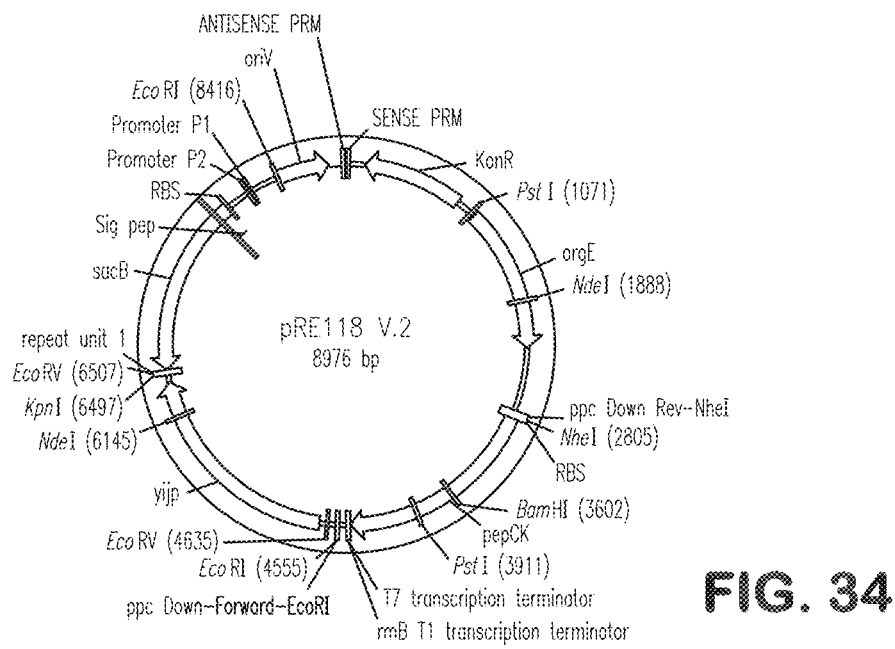
FIG. 34 shows a plasmid map for the vector pRE118-V2.

The chromosomal gene replacement was performed using a non-replicative plasmid and the sacB gene from Bacillus subtilis as a means of counterselection (Gay et al., J. Bacteriol. 153:1424-1431 (1983)). The vector used is pRE118 (ATCC87693) deleted of the oriT and IS sequences, which is 3.6 kb in size and carrying the kanamycin resistance gene. The sequence was confirmed, and the vector was called pRE118-V2 (see FIG. 34).

The E. coli fragments flanking the lpdA gene were amplified by PCR using the combination of primers: EC-aceF-Pst (5'-aagccgttgctgcagctcttgagc-3')(SEQ ID NO:14)+EC-aceF-Bam2 (5'-atctccggccggtcggatccgtcg-3')(SEQ ID NO: 15) and EC-yacH-Nhe (5'-aaagcggctagccacgccgc-3')(SEQ ID NO: 16)+EC-yacH-Kpn (5'-attacacgaggtacccaacg-3')(SEQ ID NO: 17). A BamHI-XbaI fragment containing the lpd4 gene of K. pneumonia was isolated from plasmid pCR-KP-lpdA and was then ligated to the above E. coli fragments digested with PstI+BamHI and NheI-KpnI respectively, and the pRE118-V2 plasmid digested with KpnI and PstI. The resulting plasmid (called pRE118-M2.11pdAyac) was subjected to Site Directed Mutagenesis (SDM) using the combination of primers KP-lpdA-HisTyr-F (5'-atgctggcgta-caaaggtgtcc-3')(SEQ ID NO: 18) and (5'-ggacacctttgtacgccagcat-3')(SEQ ID NO: 19) for the mutation of the His 322 residue to a Tyr residue or primers KP-lpdA-GluLys-F (5'-atcgcctacactaaaccagaagtgg-3')(SEQ ID NO:20) and KP-lpdA-GluLys-R (5'-ccacttctggtt-tagtgtaggcgat-3')(SEQ ID NO:21) for the mutation of the residue Glu 354 to Lys residue. PCR was performed with the Polymerase Pfu Turbo (Stratagene; San Diego CA). The sequence of the entire fragment as well as the presence of only the desired mutations was verified. The resulting plasmid was introduced into electro competent cells of E. coli ΔadhE::Frt-ΔldhA::Frt by transformation. The first integration event in the chromosome was selected on LB agar plates containing Kanamycin (25 or 50 mg/L). Correct insertions were verified by PCR using 2 primers, one located outside the region of insertion and one in the kanamycin gene (5'-aggcagttccataggatggc-3') (SEQ ID NO:22). Clones with the correct insertion were selected for resolution. They were sub-cultured twice in plain liquid LB at the desired temperature and serial dilutions were plated on LB-no salt-sucrose 10% plates. Clones that grew on sucrose containing plates were screened for the loss of the kanamycin resistance gene on LB-low salt agar medium and the lpdA gene replacement was verified by PCR and sequencing of the encompassing region. Sequence of the insertion region was verified, and is as described below. One clone (named 4-4-P1) with mutation Glu354Lys was selected. This clone was then transduced with P1 lysate of E. coli ΔPflB::Frt leading to strain ECKh-138 (ΔadhE ΔldhA ΔpflB ΔlpdA:: K.p.lpdA322).

The sequence of the ECKh-138 region encompassing the aceF and lpdA genes is shown in FIG. 35. The K. pneumonia lpdA gene is underlined, and the codon changed in the Glu354Lys mutant shaded. The protein sequence comparison of the native E. coli lpdA and the mutant K. pneumonia lpd4 is shown in FIG. 36.

To evaluate the benefit of using K. pneumoniae lpdA in a BDO production strain, the host strains AB3 and ECKh-138 were transformed with plasmids expressing the entire BDO pathway from strong, inducible promoters. Specifically, E. coli sucCD, P. gingivalis sucD, P. gingivalis 4hbd were expressed on the medium copy plasmid pZA33, and P. gingivalis Cat2 and C. acetobutylicum AdhE2 were expressed on the high copy plasmid pZE13. These plasmids have been described in the literature (Lutz and H. Bujard, Nucleic Acids Res 25:1203-1210 (1997)), and their use for BDO pathway expression is described in Example XIII and WO2008/115840. BDO and 4HB production in ECKh-138 was significantly higher after 48 hours than in AB3 or the host used in previous work, MG1655 ΔldhA (FIG. 37).

Figure 40:
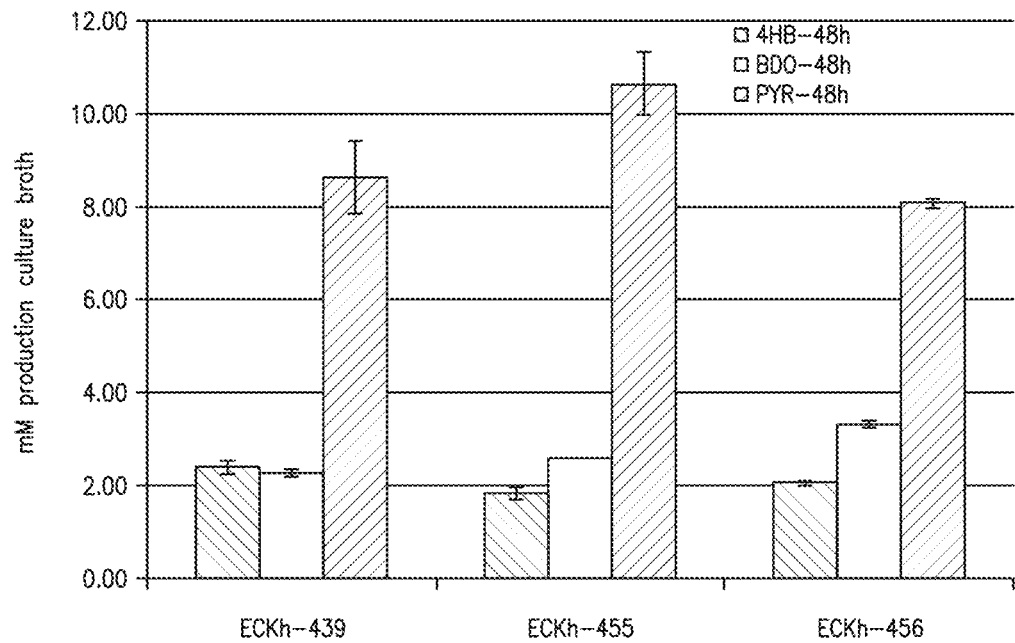
FIG. 40 shows the production of 4-hydroxybutyrate, BDO and pyruvate (left to right bars, respectively) for each of strains ECKh-439, ECKh-455 and ECKh-456.

PDH Promoter Replacement. It was previously shown that the replacement of the pdhR repressor by a transcriptional fusion containing the Fnr binding site, one of the pflB promoters, and its ribosome binding site (RBS), thus leading to expression of the aceEF-lpd operon by an anaerobic promoter, should increase pdh activity anaerobically (Zhou et al., Biotechnol. Lett. 30:335-342 (2008)). A fusion containing the Fnr binding site, the pflB-p6 promoter and an RBS binding site were constructed by overlapping PCR. Two fragments were amplified, one using the primers aceE-upstream-RC (5'-tgacatgtaacacc-taccttctgtgcctgtgccagtggttgctgtgatatagaag-3')(SEQ ID NO:23) and pflBp6-Up-Nde (5'-ataataatacatatgaac-catgcgagttacgggcctataagccaggcg-3')(SEQ ID NO:24) and the other using primers aceE-EcoRV-EC (5'-agttttttcgatatctg-catcagacaccggcacattgaaacgg-3')(SEQ ID NO:25) and aceE-upstream (5'-ctggcacaggcacagaaggtaggtgttacatgtcagaacgtt-tacacaatgacgtggatc-3')(SEQ ID NO:26). The tw fragments were assembled by overlapping PCR, and the final DNA fragment was digested with the restriction enzymes NdeI and BamHI. This fragment was subsequently introduced upstream of the aceE gene of the E. coli operon using pRE118-V2 as described above. The replacement was done in strains ECKh-138 and ECKh-422. The nucleotide sequence encompassing the 5' region of the aceE gene was verified and is shown in FIG. 38. FIG. 38 shows the nucleotide sequence of 5' end of the aceE gene fused to the pflB-p6 promoter and ribosome binding site (RBS). The 5' italicized sequence shows the start of the aroP gene, which is transcribed in the opposite direction from the pdh operon. The 3' italicized sequence shows the start of the aceE gene. In upper case: pflB RBS. Underlined: FNR binding site. In bold: pflB-p6 promoter sequence.

lpdA Promoter Replacement. The promoter region containing the fnr binding site, the pflB-p6 promoter and the RBS of the pflB gene was amplified by PCR using chromosomal DNA template and primers aceF-pflBp6-fwd (5'-agacaaatcggttgccgtttgttaagccaggcgagatatgatctatatc-3')(SEQ ID NO:27) and lpdA-RBS-B-rev (5'-gagttttgatttcagtactcat-catgtaacacctaccttcttgctgtgatatag-3')(SEQ ID NO:28). Plasmid 2-4a was amplified by PCR using primers B-RBS-lpdA fwd (5'-ctatatcacagcaagaaggtaggtgttacatgatgagtactgaaat-caaaactc-3')(SEQ ID NO:29) and pflBp6-aceF-rev (5'-ga-tatagatcatatctcgcctggcttaacaaacggcaaccgatttgtct-3')(SEQ ID NO:30). The two resulting fragments were assembled using the BPS cloning kit (BPS Bioscience; San Diego CA). The resulting construct was sequenced verified and introduced into strain ECKh-439 using the pRE118-V2 method described above. The nucleotide sequence encompassing the aceF-lpdA region in the resulting strain ECKh-456 is shown in FIG. 39. 48 hours after induction with 0.2 mM IPTG, the concentrations of BDO, 4HB, and pyruvate were as shown in FIG. 40.

These results demonstrated that expression of pyruvate dehydrogenase increased production of BDO in BDO producing strains.

Example XV

BDO Producing Strains Expressing Citrate Synthase and Aconitase

This example describes increasing activity of citrate synthase and aconitase to increase production of BDO. An R163L mutation into gltA was found to improve BDO production. Additionally, an arcA knockout was used to improve BDO production. See corresponding example in WO2013/186402.

The following oligonucleotides were used to PCR amplify the chloramphenicol resistance gene (CAT) flanked by FRT sites from pKD3:

S-mdh-Kan
(SEQ ID NO: 31)
5'-TAT TGT GCA TAC AGA TGA ATT TTT ATG CAA ACA GTC

AGC CCT GAA GAA GG<u>G TGT AGG CTG GAG CTG CTT C</u>-3'

AS-mdh-Kan
(SEQ ID NO: 32)
5'-CAA AAA ACC GGA GTC TGT GCT CCG GTT TTT TAT TAT

CCG CTA ATC AAT TAC <u>ATA TGA ATA TCC TCC TTA G</u>-3'.

Figure 41A:
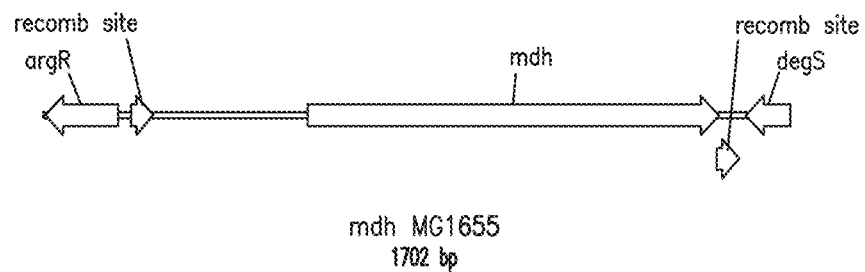
FIG. 41A shows a schematic of the recombination sites for deletion of the mdh gene.
Figure 41B:
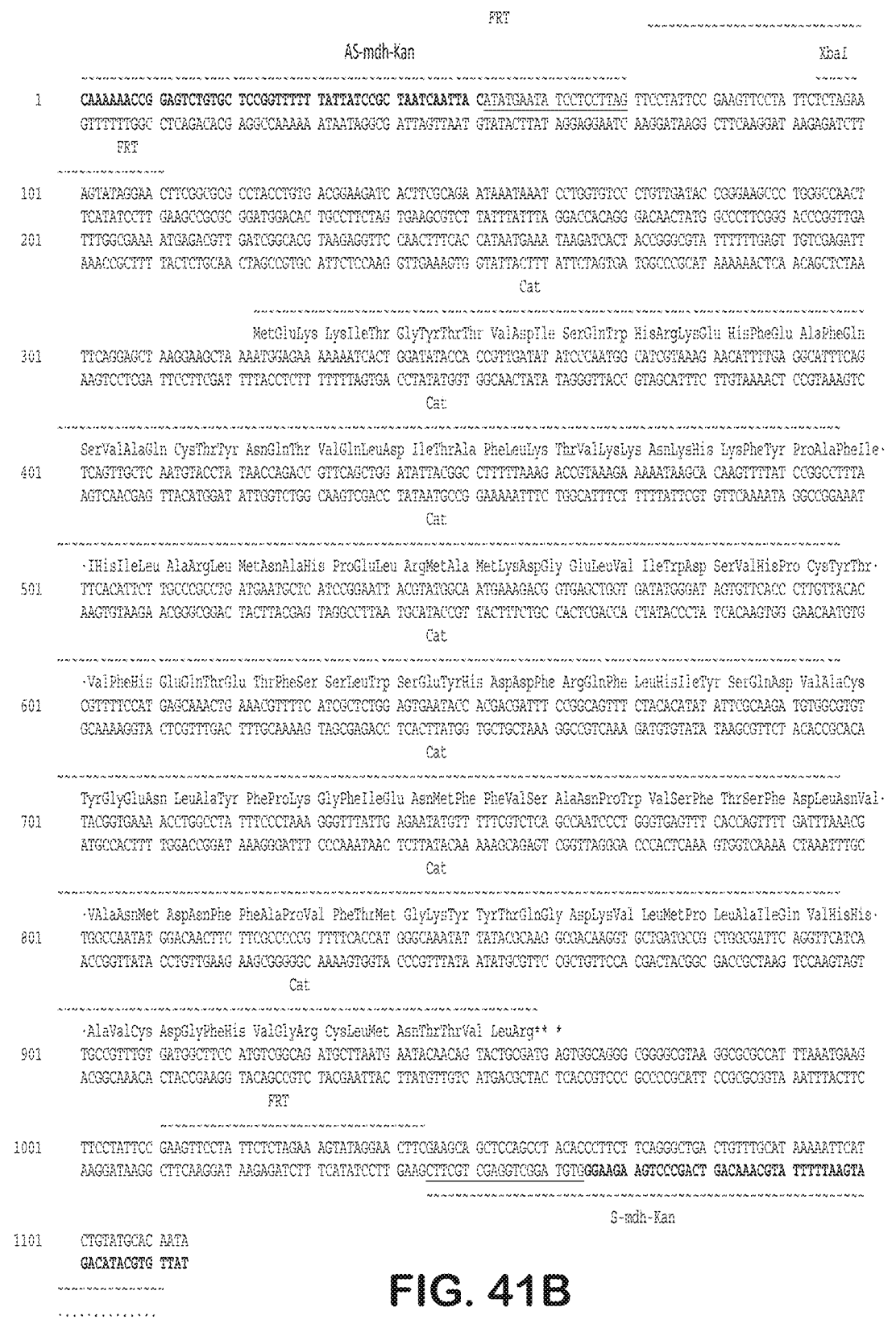

The PCR product was designed so that it integrated into the ECKh-138 genome at a region upstream of the mdh gene, as shown in FIG. 41.

The upstream and downstream regions of the arcA gene of E. coli MG1655 were amplified by PCR using primers ArcA-up-EcoRI (5'-ataataatagaattcgtttgctacctaaattgc-caactaaatcgaaacagg-3')(SEQ ID NO:33) with ArcA-up-KpnI (5'-tattattatggtaccaatatcatgcagcaaacggtgcaacattgccg-3') (SEQ ID NO:34) and ArcA-down-EcoRI (5'-tgatctggaagaat-tcatcggctttaccaccgtcaaaaaaaacggcg-3')(SEQ ID NO:35) with ArcA-down-PstI (5'-ataaaaccctgcagcggaaacgaagttttatc-cattttttggttacctg-3')(SEQ ID NO:36), respectively. After integration and resolution on LB-no salt-sucrose plates as described above, the deletion of the arcA gene in the chromosome of the resulting strain ECKh-401 was verified by sequencing and is shown in FIG. 42. The gltA gene of E. coli MG1655 was amplified by PCR using primers gltA-up (5'-ggaagagaggctggtacccagaagccacagcagga-3')(SEQ ID NO:37) and gltA-PstI (5'-gtaatcactgcgtaagcgc-catgccccggcgttaattc-3')(SEQ ID NO:38). The amplified fragment was cloned into pRE118-V2 after digestion with KpnI and PstI. The resulting plasmid was called pRE118-gltA. This plasmid was then subjected to site directed mutagensis (SDM) using primers R163L-f (5'-at-tgccgcgttcctcctgctgtcga-3')(SEQ ID NO:39) and R163L-r (5'-cgacagcaggaggaacgcggcaat-3')(SEQ ID NO:40) to change the residue Arg 163 to a Lys residue. The sequence of the entire fragment was verified by sequencing The resulting strain was called ECKh-422, and has the genotype ΔadhE ΔldhA ΔpflB ΔlpdA::K.p.lpdA322 Δmdh ΔarcA gltAR163L. The region encompassing the mutated gltA gene of strain ECKh-422 was verified by sequencing, as shown in FIG. 43. FIG. 44 shows the citrate synthase activity of wild type gltA gene product and the R163L mutant. The assay was performed in the absence or presence of 0.4 mM NADH.

Strains ECKh-401 and ECKh-422 were transformed with plasmids expressing the entire BDO pathway. *E. coli* sucCD, *P. gingivalis* sucD, *P. gingivalis* 4hbd, and *M. bovis* sucA were expressed on the low copy plasmid pZS*13, and *P. gingivalis* Cat2 and *C. acetobutylicum* AdhE2 were expressed on the medium copy plasmid pZE23. Cultures of these strains were grown microaerobically in M9 minimal medium supplemented with 20 g/L glucose and the appropriate antibiotics as described above. The 4HB and BDO concentrations at 48 hours post-induction averaged from duplicate cultures are shown in FIG. 45. Both are higher in ECKh-422 than in ECKh-401, demonstrating that the enhanced citrate synthase activity due to the gltA mutation results in increased flux to the BDO pathway.

Figure 46:
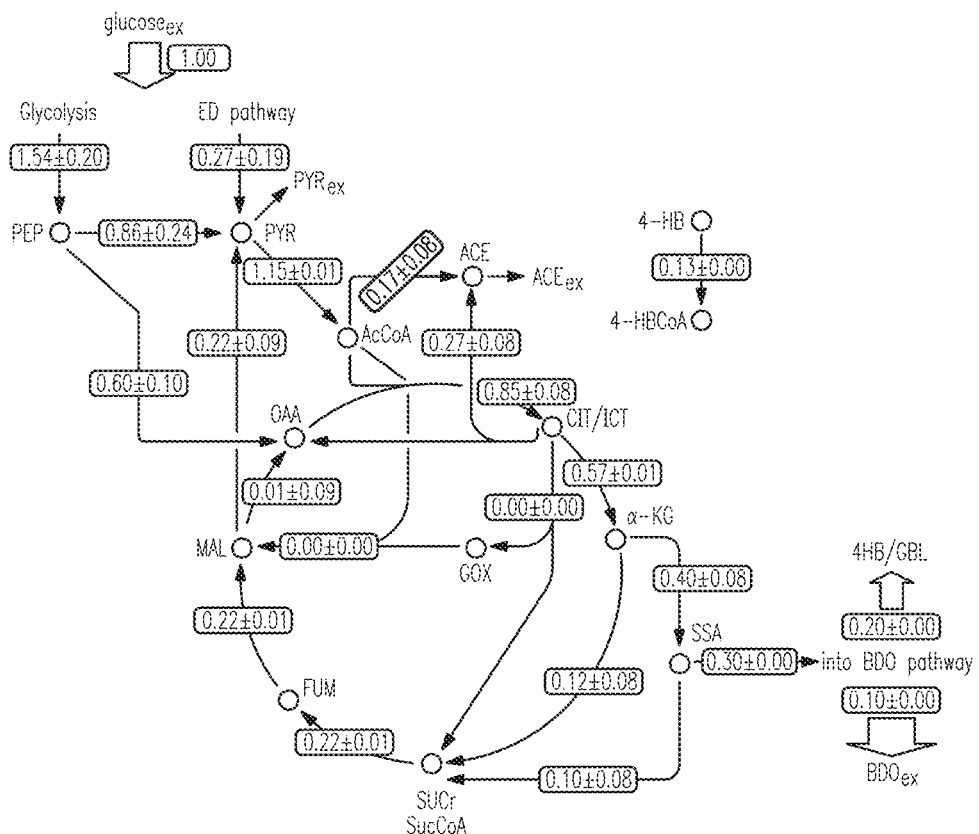
FIG. 46 shows central metabolic fluxes and associated 95% confidence intervals from metabolic labeling experiments. Values are molar fluxes normalized to a glucose uptake rate of 1 mmol/hr. The result indicates that carbon flux is routed through citrate synthase in the oxidative direction and that most of the carbon enters the BDO pathway rather than completing the TCA cycle.

The host strain modifications described in this section were intended to redirect carbon flux through the oxidative TCA cycle, which is consistent with the OptKnock strain design described in WO 2009/023493 and U.S. publication 2009/0047719. To demonstrate that flux was indeed routed through this pathway, $^{13}$C flux analysis was performed using the strain ECKh-432, which is a version of ECKh-422 in which the upstream pathway is integrated into the chromosome (as described in Example XVII). To complete the BDO pathway, *P. gingivalis* Cat2 and *C. beijerinckii* Ald were expressed from pZS*13. Four parallel cultures were grown in M9 minimal medium (6.78 g/L Na$_2$HPO$_4$, 3.0 g/L KH$_2$PO$_4$, 0.5 g/L NaCl, 1.0 g/L NH$_4$Cl, 1 mM MgSO$_4$, 0.1 mM CaCl$_2$) containing 4 g/L total glucose of four different labeling ratios ($^{1-13}$C, only the first carbon atom in the glucose molecule is labeled with $^{13}$C; uniform-$^{13}$C, all carbon atoms are $^{13}$C):

1. 80 mol % unlabeled, 20 mol % uniform-$^{13}$C
2. 10 mol % unlabeled, 90 mol % uniform-$^{13}$C
3. 90 mol % $^{1-13}$C, 10 mol % uniform-$^{13}$C
4. 40 mol % $^{1-13}$C, 60 mol % uniform-$^{13}$C Parallel unlabeled cultures were grown in duplicate, from which frequent samples were taken to evaluate growth rate, glucose uptake rate, and product formation rates. In late exponential phase, the labeled cultures were harvested, the protein isolated and hydrolyzed to amino acids, and the label distribution of the amino acids analyzed by gas chromatography-mass spectrometry (GCMS) as described previously (Fischer and Sauer, *Eur. J. Biochem.* 270:880-891 (2003)). In addition, the label distribution of the secreted 4HB and BDO in the broth from the labeled cultures was analyzed by GCMS as described in WO2008115840. This data was collectively used to calculate the intracellular flux distribution using established methods (Suthers et al., *Metab. Eng.* 9:387-405 (2007)). The resulting central metabolic fluxes and associated 95% confidence intervals are shown in FIG. 46. Values are molar fluxes normalized to a glucose uptake rate of 1 mmol/hr. The result indicates that carbon flux is routed through citrate synthase in the oxidative direction, and that most of the carbon enters the BDO pathway rather than completing the TCA cycle. Furthermore, it confirms there is essentially no flux between malate and oxaloacetate due to the mdh deletion in this strain.

Figure 47A:
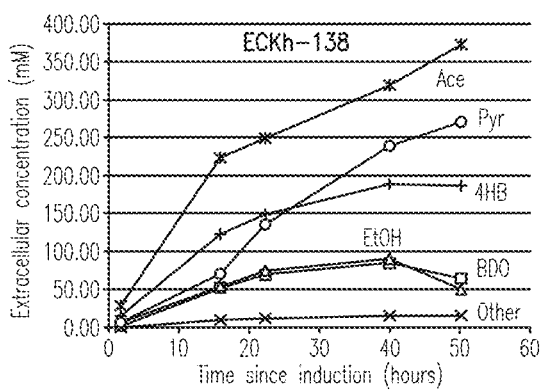
FIGS. 47A-47B show extracellular product formation for strains ECKh-138 (FIG. 47A) and ECKh-422 (FIG. 47B), both expressing the entire BDO pathway on plasmids. The products measured were acetate (Ace), pyruvate (Pyr), 4-hydroxybutyrate (4HB), 1,4-butanediol (BDO), ethanol (EtOH), and other products, which include gamma-butyrolactone (GBL), succinate, and lactate.
Figure 47B:
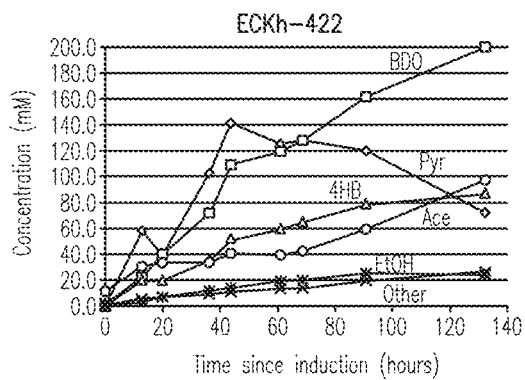

The advantage of using a knockout strain such as strains designed using OptKnock for BDO production (see WO 2009/023493 and U.S. publication 2009/0047719) can be observed by comparing typical fermentation profiles of ECKh-422 with that of the original strain ECKh-138, in which BDO is produced from succinate via the reductive TCA cycle (see FIG. 47). Fermentations were performed with 1 L initial culture volume in 2 L Biostat B+ bioreactors (Sartorius; Cedex France) using M9 minimal medium supplemented with 20 g/L glucose. The temperature was controlled at 37° C., and the pH was controlled at 7.0 using 2 M NH$_4$OH or Na$_2$CO$_3$. Cells were grown aerobically to an OD600 of approximately 10, at which time the cultures were induced with 0.2 mM IPTG One hour following induction, the air flow rate was reduced to 0.02 standard liters per minute for microaerobic conditions. The agitation rate was set at 700 rpm. Concentrated glucose was fed to maintain glucose concentration in the vessel between 0.5 and 10 g/L. Both strains were transformed with plasmids bearing the entire BDO pathway, as in the examples above. In ECKh-138, acetate, pyruvate, and 4HB dominate the fermentation, while with ECKh-422 BDO is the major product.

Example XVI

BDO Strains Expression Phosphoenolpyruvate Carboxykinase

This example describes the utilization of phosphoenolpyruvate carboxykinase (PEPCK) to enhance BDO production. The *Haemophilus influenza* PEPCK gene was used for heterologous expression. See corresponding example in WO2013/186402.

Figure 49:
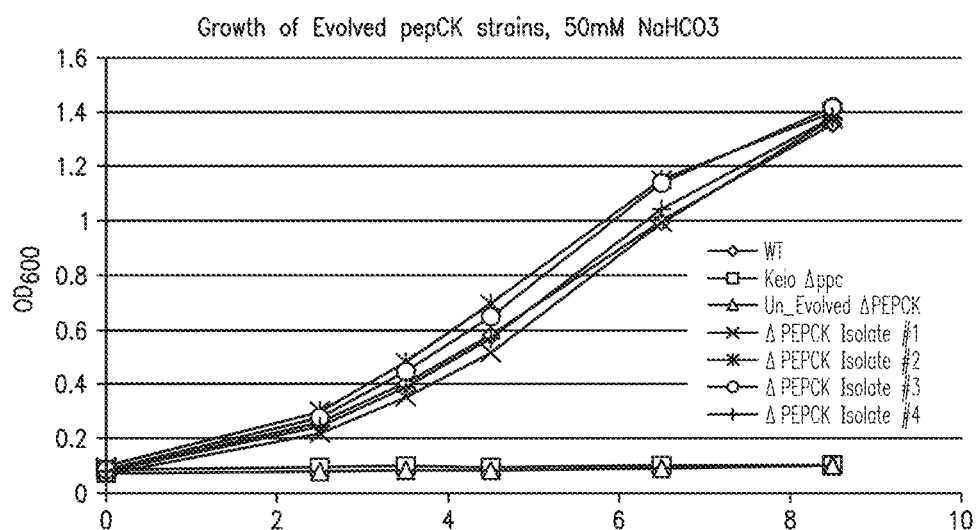
FIG. 49 shows growth of evolved pepCK strains grown in minimal medium containing 50 mM NaHCO₃.
Figure 50:
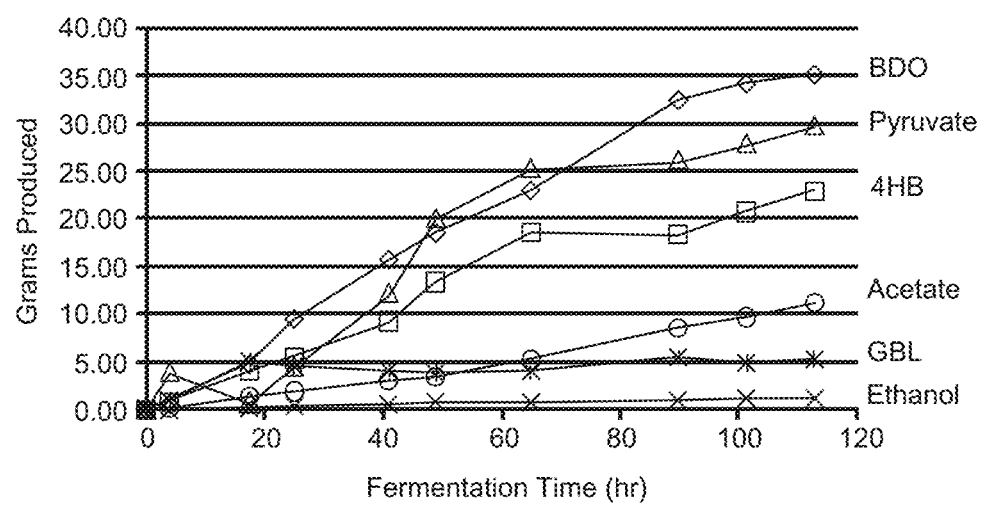
FIG. 50 shows product formation in strain ECKh-453 expressing *P. gingivalis* Cat2 and *C. beijerinckii* Ald on the plasmid pZS*13. The products measured were 1,4-butanediol (BDO), pyruvate, 4-hydroxybutyrate (4HB), acetate, γ-butyrolactone (GBL) and ethanol.
Figure 51:
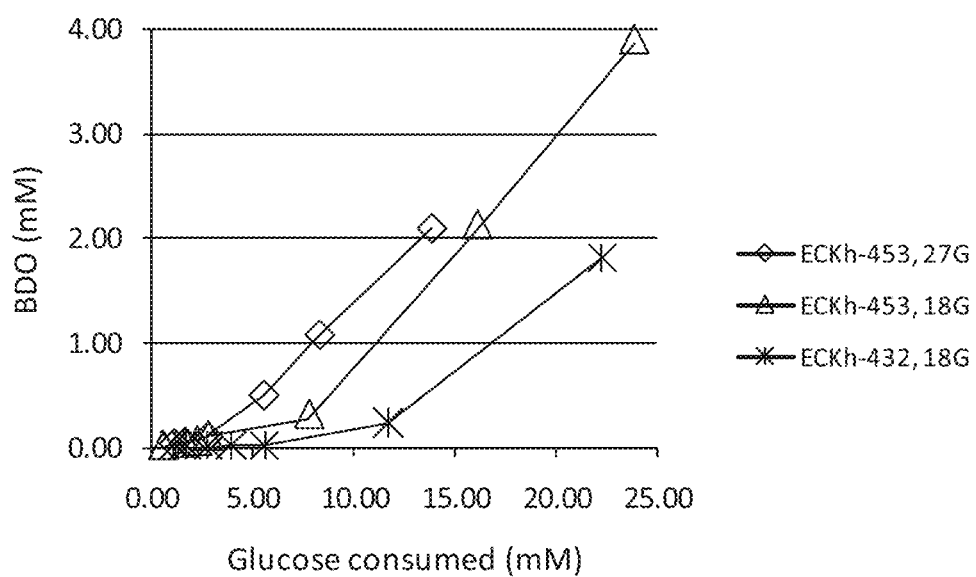
FIG. 51 shows BDO production of two strains, ECKh-453 and ECKh-432. Both contain the plasmid pZS*13 expressing *P. gingivalis* Cat2 and *C. beijerinckii* Ald. The cultures were grown under microaerobic conditions, with the vessels punctured with 27 or 18 gauge needles, as indicated.

Briefly, three non native PEPCK enzymes were tested for their ability to complement growth of a PPC mutant strain of *E. coli* in glucose minimal media: *Haemophilus influenza* (NC 000907.1); *Actinobacillus succinogenes* (YP_001343536.1); and *Mannheimia succiniciproducens* (YP_089485.1). *Haemophilus influenza* PEPCK was integrated into the PPC locus of wild-type *E. coli* (MG1655) (sequence of this region shown in FIG. 48 (pepck coding region underlined). Techniques for adaptive evolution were applied to improve the growth rate of the *E. coli* mutant (Δppc::H. inf pepCK). Following evolution, individual colonies were isolated, and growth in anaerobic bottles was compared to that of the initial mutant and wild-type strain (see FIG. 49). The ppc/pepck gene replacement procedure described above was then repeated, this time using the BDO-producing strains ECKh-432 (ΔadhE ΔldhA ΔpflB ΔlpdA::K.p.lpdA322 Δmdh ΔarcA gltAR163L ΔackA fimD:: *E. coli* sucCD, *P. gingivalis* sucD, *P. gingivalis* 4hbd fimD:: *M. bovis* sucA, *C. kluyveri* 4hbd) and ECKh-439 as the hosts. The Δppc::H. inf pepCK derivative of ECKh-439, called ECKh-453, was run in a fermentation. The downstream BDO pathway was supplied by pZS*13 containing *P. gingivalis* Cat2 and *C. beijerinckii* Ald. The product profile is shown in FIG. 50. The growth coupling potential of ECKh-432 and ECKh-453 was evaluated by growth in microaerobic bottles with frequent sampling during the exponential phase. As shown in FIG. 51, ECKh-432 does not begin producing BDO until 5 g/L glucose has been consumed, corresponding to the onset of stationary phase. ECKh-453 produces BDO more evenly throughout the experiment.

Example XVII

Integration of BDO Pathway Encoding Genes at Specific Integration Sites

This example describes integration of various BDO pathway genes into the fimD locus to provide more efficient expression and stability. See corresponding example in WO2013/186402.

The entire upstream BDO pathway, leading to 4HB, has been integrated into the *E. coli* chromosome at the fimD locus. A polycistronic DNA fragment containing a promoter, the sucCD gene, the sucD gene and the 4hbd gene and a terminator sequence was inserted into the AflIII site of the pKD3 plasmid. The following primers were used to amplify the operon together with the chloramphenicol marker from the plasmid. The underlined sequences are homologous to the target insertion site.

```
                                        (SEQ ID NO: 41)
5'-GTTTGCACGCTATAGCTGAGGTTGTTGTCTTCCAGCAA

CGTACCGTATACAATAGGCGTATCACGAGGCCCTTTC-3';
                                        (SEQ ID NO: 42)
5'-GCTACAGCATGTCACACGATCTCAACGGTCGGATGAC

CAATCTGGCTGGTATGGGAATTAGCCATGGTCC-3'.
```

Figure 54:
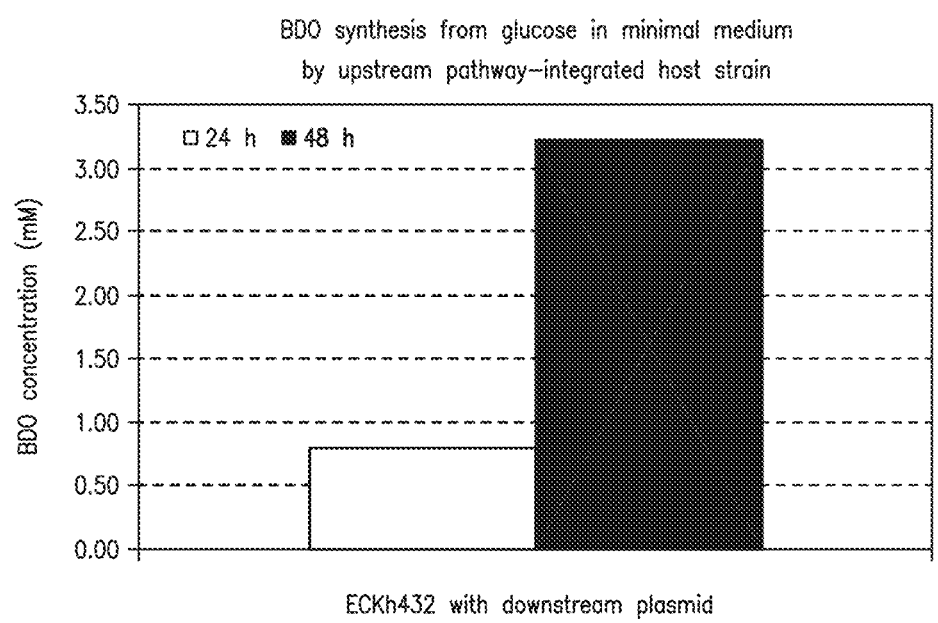
FIG. 54 shows BDO synthesis from glucose in minimal medium in the ECKh-432 strain having upstream BDO pathway encoding genes intregrated into the chromosome and containing a plasmid harboring downstream BDO pathway genes.

The nucleotide sequence of the region after insertion and marker removal is shown in FIG. 52. The alpha-ketoglutarate branch of the upstream pathway was integrated into the chromosome by homologeous recombination. The integration plasmid also contained a polycistronic sequence with a promoter, the sucA gene, the *C. kluyveri* 4hbd gene, and a terminator being inserted between two 1.5-kb DNA fragments that are homologous to the flanking regions of the target insertion site. The nucleotide sequence of the chromosomal region after insertion and marker removal is shown in FIG. 53. The resulting upstream pathway integration strain ECKh-432 was transformed with a plasmid harboring the downstream pathway genes. The construct was able to produce BDO from glucose in minimal medium (see FIG. 54).

Example XVIII

Use of a Non-Phosphotransferase Sucrose Uptake System to Reduce Pyruvate Byproduct Formation This example describes the utilization of a non-phosphotransferase (PTS) sucrose uptake system to reduce pyruvate as a byproduct in the conversion of sucrose to BDO. See corresponding example in WO2013/186402.

Strains engineered for the utilization of sucrose via a phosphotransferase (PTS) system produce significant amounts of pyruvate as a byproduct. Therefore, the use of a non-PTS sucrose system can be used to decrease pyruvate formation because the import of sucrose would not be accompanied by the conversion of phosphoenolpyruvate (PEP) to pyruvate. This will increase the PEP pool and the flux to oxaloacetate through PPC or PEPCK.

Insertion of a non-PTS sucrose operon into the rrnC region was performed. To generate a PCR product containing the non-PTS sucrose genes flanked by regions of homology to the rnC region, two oligos were used to PCR amplify the csc genes from Mach1™ (Invitrogen, Carlsbad, CA). This strain is a descendent of W strain which is an *E. coli* strain known to be able to catabolize sucrose (Orencio-Trejo et al., *Biotechnology Biofuels* 1:8 (2008)). The sequence was derived from *E. coli* W strain KO11 (accession AY314757) (Shukla et al., *Biotechnol. Lett.* 26:689-693 (2004)) and includes genes encoding a sucrose permease (cscB), D-fructokinase (cscK), sucrose hydrolase (cscA), and a Lac-related sucrose-specific repressor (cscR)(see also CAA57217.1 for cscB, CAA57219.1 for cscA, and CAA57218.1 for cscK). The first 53 amino acids of cscR was effectively removed by the placement of the AS primer. The sequences of the

```
rrnC 23S del S-CSC
                                        (SEQ ID NO: 43)
5'-TGT GAG TGA AAG TCA CCT GCC TTA ATA TCT CAA AAC

TCA TCT TCG GGT GAC GAA ATA TGG CGT GAC TCG ATA

C-3' and
rrnC 23S del AS-CSC
                                        (SEQ ID NO: 44)
5'-TCT GTA TCA GGC TGA AAA TCT TCT CTC ATC CGC CAA

AAC AGC TTC GGC GTT AAG ATG CGC GCT CAA GGA C-3'.
```

Figure 56:
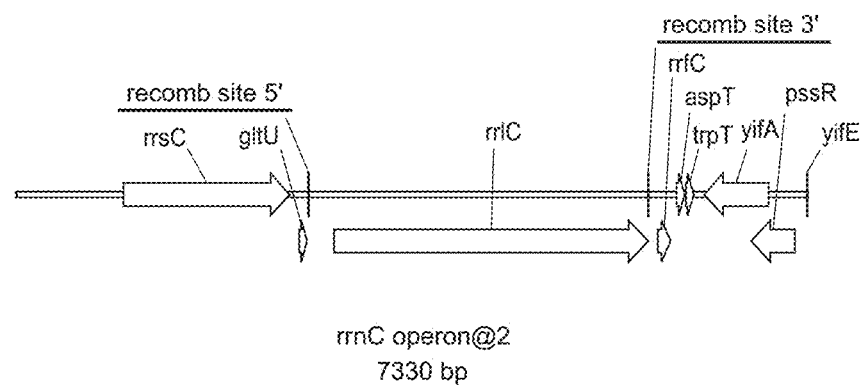
FIG. 56 shows a schematic diagram of the integrations site in the rrnC operon.

Underlined regions indicate homology to the csc operon, and bold sequence refers to sequence homology upstream and downstream of the rrnC region. The sequence of the entire PCR product is shown in FIG. 55. The PCR product was designed so that it integrated into genome into the rrnC region of the chromosome, effectively deleting 191 nucleotides upstream of rrlC (23 S rRNA), all of the rrlC rRNA gene and 3 nucleotides downstream of rrlC and replacing it with the sucrose operon, as shown in FIG. 56.

Figure 57:
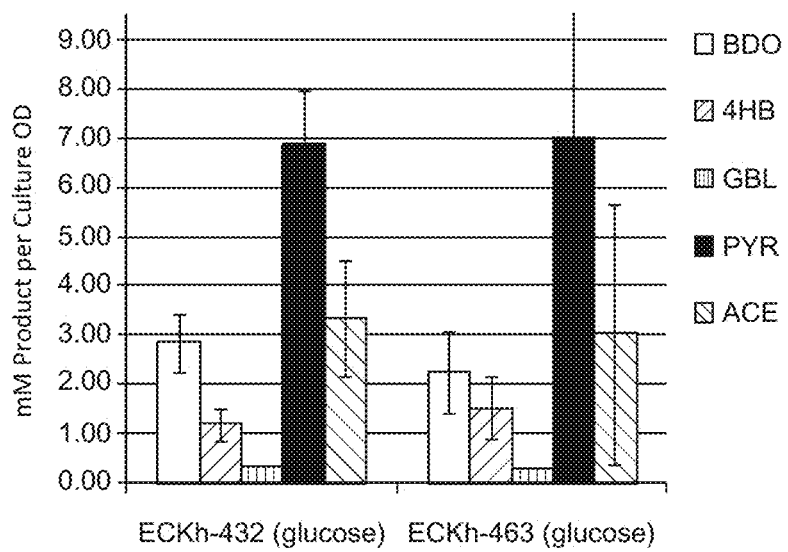
FIG. 57 shows average product concentration, normalized to culture OD600, after 48 hours of growth of strain ECKh-432 grown on glucose and strain ECKh-463 grown on sucrose. Both contain the plasmid pZS*13 expressing *P. gingivalis* Cat2 and *C. beijerinckii* Ald. The data is for 6 replicate cultures of each strain. The products measured were 1,4-butanediol (BDO), 4-hydroxybutyrate (4HB), γ-butyrolactone (GBL), pyruvate (PYR) and acetate (ACE) (left to right bars, respectively).

ECKh-463 was transformed with pZS*13 containing *P. gingivalis* Cat2 and *C. beijerinckii* Ald to provide a complete BDO pathway. Cells were cultured in M9 minimal medium (6.78 g/L Na$_2$HPO$_4$, 3.0 g/L KH$_2$PO$_4$, 0.5 g/LNaCl, 1.0 g/L NH$_4$Cl, 1 mM MgSO$_4$, 0.1 mM CaCl$_2$) supplemented with 10 g/L sucrose. 0.2 mM IPTG was present in the culture from the start. Anaerobic conditions were maintained using a bottle with 23G needle. As a control, ECKh-432 containing the same plasmid was cultured on the same medium, except with 10 g/L glucose instead of sucrose. FIG. 57 shows average product concentration, normalized to culture OD600, after 48 hours of growth. The data is for 6 replicate cultures of each strain. This demonstrates that BDO production from ECKh-463 on sucrose is similar to that of the parent strain on sucrose.

Example XIX

Summary of BDO Producing Strains

This example describes various BDO producing strains.

Table 18 summarizes various BDO producing strains disclosed above in Examples XII-XVIII.

TABLE 18

Summary of various BDO production strains.

| Strain # | Host Strain # | Host chromosome | Host Description | Plasmid-based |
|---|---|---|---|---|
| 1 | | ΔldhA | Single deletion derivative of *E. coli* MG1655 | *E. coli* sucCD, *P. gingivalis* sucD, *P. gingivalis* 4hbd, *P. gingivalis* Cat2, *C. acetobutylicum* AdhE2 |

TABLE 18-continued

Summary of various BDO production strains.

| Strain # | Host Strain # | Host chromosome | Host Description | Plasmid-based |
|---|---|---|---|---|
| 2 | AB3 | ΔadhE ΔldhA ΔpflB | Succinate producing strain; derivative of *E. coli* MG1655 | *E. coli* sucCD, *P. gingivalis* sucD, *P. gingivalis* 4hbd, *P. gingivalis* Cat2, *C. acetobutylicum* AdhE2 |
| 3 | ECKh-138 | ΔadhE ΔldhA ΔpflB ΔlpdA::K.p.lpdA322 | Improvement of lpdA to increase pyruvate dehydrogenase flux | *E. coli* sucCD, *P. gingivalis* sucD, *P. gingivalis* 4hbd, *P. gingivalis* Cat2, *C. acetobutylicum* AdhE2 |
| 4 | ECKh-138 | ΔadhE ΔldhA ΔpflB ΔlpdA::K.p.lpdA322 | | *E. coli* sucCD, *P. gingivalis* sucD, *P. gingivalis* 4hbd, *C. acetobutylicum* buk1, *C. acetobutylicum* ptb, *C. acetobutylicum* AdhE2 |
| 5 | ECKh-401 | ΔadhE ΔldhA ΔpflB ΔlpdA::K.p.lpdA322 Δmdh ΔarcA | Deletions in mdh and arcA to direct flux through oxidative TCA cycle | *E. coli* sucCD, *P. gingivalis* sucD, *P. gingivalis* 4hbd, *P. gingivalis* Cat2, *C. acetobutylicum* AdhE2 |
| 6 | ECKh-401 | ΔadhE ΔldhA ΔpflB ΔlpdA::K.p.lpdA322 Δmdh ΔarcA | | *M. bovis* sucA, *E. coli* sucCD, *P. gingivalis* sucD, *P. gingivalis* 4hbd, *P. gingivalis* Cat2, *C. acetobutylicum* AdhE2 |
| 7 | ECKh-422 | ΔadhE ΔldhA ΔpflB ΔlpdA::K.p.lpdA322 Δmdh ΔarcA gltAR163L | Mutation in citrate synthase to improve anaerobic activity | *E. coli* sucCD, *P. gingivalis* sucD, *P. gingivalis* 4hbd, *P. gingivalis* Cat2, *C. acetobutylicum* AdhE2 |
| 8 | ECKh-422 | ΔadhE ΔldhA ΔpflB ΔlpdA::K.p.lpdA322 Δmdh ΔarcA gltAR163L | | *M. bovis* sucA, *E. coli* sucCD, *P. gingivalis* sucD, *P. gingivalis* 4hbd, *P. gingivalis* Cat2, *C. acetobutylicum* AdhE2 |
| 9 | ECKh-422 | ΔadhE ΔldhA ΔpflB ΔlpdA::K.p.lpdA322 Δmdh ΔarcA gltAR163L | | *M. bovis* sucA, *E. coli* sucCD, *P. gingivalis* sucD, *P. gingivalis* 4hbd, *P. gingivalis* Cat2, *C. beijerinckii* Ald |
| 10 | ECKh-426 | ΔadhE ΔldhA ΔpflB ΔlpdA::K.p.lpdA322 Δmdh ΔarcA gltAR163L fimD:: *E. coli* sucCD, *P. gingivalis* sucD, *P. gingivalis* 4hbd | Succinate branch of upstream pathway integrated into ECKh-422 | *P. gingivalis* Cat2, *C. beijerinckii* Ald |
| 11 | ECKh-432 | ΔadhE ΔldhA ΔpflB ΔlpdA::K.p.lpdA322 Δmdh ΔarcA gltAR163L fimD:: *E. coli* sucCD, *P. gingivalis* sucD, *P. gingivalis* 4hbd fimD:: *M. bovis* sucA, *C. kluyveri* 4hbd | Succinate and alpha-ketoglutarate upstream pathway branches integrated into ECKh-422 | *P. gingivalis* Cat2, *C. beijerinckii* Ald |
| 12 | ECKh-432 | ΔadhE ΔldhA ΔpflB ΔlpdA::K.p.lpdA322 Δmdh ΔarcA gltAR163L fimD:: *E. coli* sucCD, *P. gingivalis* sucD, *P. gingivalis* 4hbd fimD:: *M. bovis* sucA, *C. kluyveri* 4hbd | | *C. acetobutylicum* buk1, *C. acetobutylicum* ptb, *C. beijerinckii* Ald |
| 13 | ECKh-439 | ΔadhE ΔldhA ΔpflB ΔlpdA::K.p.lpdA322 Δmdh ΔarcA gltAR163L ΔackA fimD:: *E. coli* sucCD, *P. gingivalis* sucD, *P. gingivalis* 4hbd fimD:: *M. bovis* sucA, *C. kluyveri* 4hbd | Acetate kinase deletion of ECKh-432 | *P. gingivalis* Cat2, *C. beijerinckii* Ald |
| 14 | ECKh-453 | ΔadhE ΔldhA ΔpflB ΔlpdA::K.p.lpdA322 Δmdh ΔarcA gltAR163L ΔackA Δppc::H.i.ppck fimD:: *E. coli* sucCD, *P. gingivalis* sucD, *P. gingivalis* 4hbd fimD:: *M. bovis* sucA, *C. kluyveri* 4hbd | Acetate kinase deletion and PPC/PEPCK replacement of ECKh-432 | *P. gingivalis* Cat2, *C. beijerinckii* Ald |

TABLE 18-continued

Summary of various BDO production strains.

| Strain # | Host Strain # | Host chromosome | Host Description | Plasmid-based |
|---|---|---|---|---|
| 15 | ECKh-456 | ΔadhE ΔldhA ΔpflB ΔlpdA:fnr-pflB6-K.p.lpdA322 Δmdh ΔarcA gltAR163L fimD:: E. coli sucCD, P. gingivalis sucD, P. gingivalis 4hbd fimD:: M. bovis sucA, C. kluyveri 4hbd | Replacement of lpdA promoter with anaerobic promoter in ECKh-432 | P. gingivalis Cat2, C. beijerinckii Ald |
| 16 | ECKh-455 | ΔadhE ΔldhA ΔpflB ΔlpdA:: K.p.lpdA322 ΔpdhR:: fnr-pflB6 Δmdh ΔarcA gltAR163L fimD:: E. coli sucCD, P. gingivalis sucD, P. gingivalis 4hbd fimD:: M. bovis sucA, C. kluyveri 4hbd | Replacement of pdhR and aceEF promoter with anaerobic promoter in ECKh-432 | P. gingivalis Cat2, C. beijerinckii Ald |
| 17 | ECKh-459 | ΔadhE ΔldhA ΔpflB ΔlpdA:: K.p.lpdA322 Δmdh ΔarcA gltAR163L fimD:: E. coli sucCD, P. gingivalis sucD, P. gingivalis 4hbd fimD:: M. bovis sucA, C. kluyveri 4hbd fimD:: C. acetobutylicum buk1, C. acetobutylicum ptb | Integration of BK/PTB into ECKh-432 | C. beijerinckii Ald |
| 18 | ECKh-459 | ΔadhE ΔldhA ΔpflB ΔlpdA:: K.p.lpdA322 Δmdh ΔarcA gltAR163L fimD:: E. coli sucCD, P. gingivalis sucD, P. gingivalis 4hbd fimD:: M. bovis sucA, C. kluyveri 4hbd fimD:: C. acetobutylicum buk1, C. acetobutylicum ptb | | C. beijerinckii Ald, G. thermoglucosidasius adh1 |
| 19 | ECKh-463 | ΔadhE ΔldhA ΔpflB ΔlpdA::K.p.lpdA322 Δmdh ΔarcA gltAR163L fimD:: E. coli sucCD, P. gingivalis sucD, P. gingivalis 4hbd fimD:: M. bovis sucA, C. kluyveri 4hbd rrnC::cscAKB | Non-PTS sucrose genes inserted into ECKh-432 | P. gingivalis Cat2, C. beijerinckii Ald |
| 20 | ECKh-463 | ΔadhE ΔldhA ΔpflB ΔlpdA::K.p.lpdA322 Δmdh ΔarcA gltAR163L fimD:: E. coli sucCD, P. gingivalis sucD, P. gingivalis 4hbd fimD:: M. bovis sucA, C. kluyveri 4hbd rrnC::cscAKB | | C. acetobutylicum buk1, C. acetobutylicum ptb, C. beijerinckii Ald |

The strains summarized in Table 18 are as follows. Strain 1: Single deletion derivative of E. coli MG1655, with deletion of endogenous ldhA; plasmid expression of E. coli sucCD, P. gingivalis sucD, P. gingivalis 4hbd, P. gingivalis Cat2, C. acetobuylicum AdhE2. Strain 2: Host strain AB3, a succinate producing strain, derivative of E. coli MG1655, with deletions of endogenous adhE ldh pflB; plasmid expression of E. coli sucCD, P. gingivalis sucD, P. gingivalis 4hbd, P. gingivalis Cat2, C. acetobuylicum AdhE2.

Strain 3: Host strain ECKh-138, deletion of endogenous adhE, ldhA, pflB, deletion of endogenous lpdA and chromosomal insertion of Klebsiella pneumoniae lpdA with a Glu354Lys mutation at the lpd4 locus; plasmid expression of E. coli sucCD, P. gingivalis sucD, P. gingivalis 4hbd, P. gingivalis Cat2, C. acetobuylicum AdhE2; strain provides improvement of lpdA to increase pyruvate dehydrogenase flux. Strain 4: Host strain ECKh-138, deletion of endogenous adhE, ldhA, pflB, and lpdA, chromosomal insertion of Klebsiella pneumoniae lpd4 with a Glu354Lys mutation; plasmid expression E. coli sucCD, P. gingivalis sucD, P. gingivalis 4hbd, C. acetobuylicum buk1, C. acetobuylicum ptb, C. acetobuylicum AdhE2.

Strain 5: Host strain ECKh-401, deletion of endogenous adhE, id/A, pflB, deletion of endogenous lpdA and chromosomal insertion of Klebsiella pneumoniae lpdA with a Glu354Lys mutation at the lpdA locus, deletion of endogenous mdh and arcA; plasmid expression of E. coli sucCD, P. gingivalis sucD, P. gingivalis 4hbd, P. gingivalis Cat2, C. acetobutylicum AdhE2; strain has deletions in mdh and arcA to direct flux through oxidative TCA cycle. Strain 6: host strain ECKh-401, deletion of endogenous adhE, ldhA, pflB, deletion of endogenous lpdA and chromosomal insertion of Klebsiella pneumoniae lpdA with a Glu354Lys mutation at the lpdA locus, deletion of endogenous mdh and arcA; plasmid expression of M. bovis sucA, E. coli sucCD, P. gingivalis sucD, P. gingivalis 4hbd, P. gingivalis Cat2, C. acetobuylicum AdhE2.

Strain 7: Host strain ECKh-422, deletion of endogenous adhE, id/A, pflB, deletion of endogenous lpdA and chromosomal insertion of Klebsiella pneumoniae lpdA with a Glu354Lys mutation at the lpd4 locus, deletion of endogenous mdh and arcA, chromosomal replacement of gltA with gltA Arg163Leu mutant; plasmid expression of E. coli sucCD, P. gingivalis sucD, P. gingivalis 4hbd, P. gingivalis Cat2, C. acetobutylicum AdhE2; strain has mutation in citrate synthase to improve anaerobic activity. Strain 8: strain ECKh-422, deletion of endogenous adhE, ldhA, pflB, deletion of endogenous lpdA and chromosomal insertion of

*Klebsiella pneumoniae* lpdA with a Glu354Lys mutation at the lpdA locus, deletion of endogenous mdh and arcA, chromosomal replacement of gltA with gltA Arg163Leu mutant; plasmid expression of *M. bovis* sucA, *E. coli* sucCD, *P. gingivalis* sucD, *P. gingivalis* 4hbd, *P. gingivalis* Cat2, *C. acetobuylicum* AdhE2. Strain 9: host strain ECKh-422, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant; plasmid expression of *M. bovis* sucA, *E. coli* sucCD, *P. gingivalis* sucD, *P. gingivalis* 4hbd, *P. gingivalis* Cat2, *C. beijerinckii* Ald.

Strain 10: host strain ECKh-426, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd; plasmid expression of *P. gingivalis* Cat2, *C. beijerinckii* Ald; strain has succinate branch of upstream pathway integrated into strain ECKh-422 at the fimD locus. Strain 11: host strain ECKh-432, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd; plasmid expression of *P. gingivalis* Cat2, *C. beijerinckii* Ald; strain has succinate and alpha-ketoglutarate upstream pathway branches integrated into ECKh-422. Strain 12: host strain ECKh-432, deletion of endogenous adhE, ldhA, pflB, deletion of endogenous lpdA and chromosomal insertion of *Klebsiella pneumoniae* lpd4 with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd; plasmid expression of *C. acetobutylicum* buk1, *C. acetobutilicum* ptb, *C. beijerinckii* Ald.

Strain 13: host strain ECKh-439, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, deletion of endogenous ackA, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd; plasmid expression of *P. gingivalis* Cat2, *C. beijerinckii* Ald; strain has acetate kinase deletion in strain ECKh-432. Strain 14: host strain ECKh-453, deletion of endogenous adhE, ldhA, pflB, deletion of endogenous lpd4 and chromosomal insertion of *Klebsiella pneumoniae* lpd4 with a Glu354Lys mutation at the lpdA locus, deletion of endogenous mdh and arcA, chromosomal replacement of gltA with gltA Arg163Leu mutant, deletion of endogenous ackA, deletion of endogenousppc and insertion of *Haemophilus influenza* ppck at the ppc locus, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd; plasmid expression of *P. gingivalis* Cat2, *C. beijerinckii* Ald; strain has acetate kinase deletion and PPC/PEPCK replacement in strain ECKh-432.

Strain 15: host strain ECKh-456, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd, replacement of lpdA promoter with fnr binding site, pflB-p6 promoter and RBS of pflB; plasmid expression of *P. gingivalis* Cat2, *C. beijerinckii* Ald; strain has replacement of lpdA promoter with anaerobic promoter in strain ECKh-432. Strain 16: host strain ECKh-455, deletion of endogenous adhE, ldhA, pflB, deletion of endogenous lpdA and chromosomal insertion of *Klebsiella pneumoniae* lpd4 with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd, replacement of pdhR and aceEF promoter with fnr binding site, pflB-p6 promoter and RBS of pflB; plasmid expression of *P. gingivalis* Cat2, *C. beijerinckii* Ald; strain has replacement of pdhR and aceEF promoter with anaerobic promoter in ECKh-432.

Strain 17: host strain ECKh-459, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd, chromosomal insertion at the fimD locus of *C. acetobutylicum* buk1, *C. acetobutylicum* ptb; plasmid expression of *C. beijerinckii* Ald; strain has integration of BK/PTB into strain ECKh-432. Strain 18: host strain ECKh-459, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd, chromosomal insertion at the fimD locus of *C. acetobutylicum* buk1, *C. acetobutylicum* ptb; plasmid expression of *C. beijerinckii* Ald, *G. thermoglucosidasius* adh1.

Strain 19: host strain ECKh-463, deletion of endogenous adhE, ldhA, pflB, deletion of endogenous lpdA and chromosomal insertion of *Klebsiella pneumoniae* lpdA with a Glu354Lys mutation at the lpdA locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd, insertion at the rrnC locus of non-PTS sucrose operon genes sucrose permease (cscB), D-fructokinase (cscK), sucrose hydrolase (cscA), and a LacI-related sucrose-specific repressor (cscR); plasmid expression of *P. gingivalis* Cat2, *C. beijerinckii* Ald; strain has non-PTS sucrose genes inserted into strain ECKh-432. Strain 20: host strain ECKh-463 deletion of endogenous adhE, dl/A, pflB, deletion of endogenous lpd4 and chromosomal insertion of *Klebsiella pneumoniae* lpd4 with a Glu354Lys mutation at the lpd4 locus, deletion of endogenous mdh and arcA, chromosomal replacement of gltA with gltA Arg163Leu mutant, chromosomal insertion at the fimD locus of *E. coli* sucCD, *P. gingivalis* sucD, *P. gingivalis* 4hbd, chromosomal insertion at the fimD locus of *M. bovis* sucA, *C. kluyveri* 4hbd, insertion at the rrnC locus of non-PTS sucrose operon; plasmid expression of *C. acetobutylicum* buk1, *C. acetobutylicum* ptb, *C. beijerinckii* Ald.

In addition to the BDO producing strains disclosed herein, including those disclosed in Table 18, it is understood that additional modifications can be incorporated that further increase production of BDO and/or decrease undesirable byproducts. For example, a BDO producing strain, or a strain of Table 18, can incorporate additional knockouts to further increase the production of BDO or decrease an undesirable byproduct. Exemplary knockouts have been described previously (see U.S. publication 2009/0047719). Such knockout strains include, but are not limited to, one ore more genes selected from ADHEr, NADH6; ADHEr, PPCK; ADHEr, SUCD4; ADHEr, ATPS4r; ADHEr, FUM; ADHEr, MDH; ADHEr, PFLi, PPCK; ADHEr, PFLi, SUCD4; ADHEr, ACKr, NADH6; ADHEr, NADH6, PFLi; ADHEr, ASPT, MDH; ADHEr, NADH6, PPCK; ADHEr, PPCK, THD2; ADHEr, ATPS4r, PPCK; ADHEr, MDH, THD2; ADHEr, FUM, PFLi; ADHEr, PPCK, SUCD4; ADHEr, GLCpts, PPCK; ADHEr, GLUDy, MDH; ADHEr, GLUDy, PPCK; ADHEr, FUM, PPCK; ADHEr, MDH, PPCK; ADHEr, FUM, GLUDy; ADHEr, FUM, HEX1; ADHEr, HEX1, PFLi; ADHEr, HEX1, THD2; ADHEr, FRD2, LDH_D, MDH; ADHEr, FRD2, LDH_D, ME2; ADHEr, MDH, PGL, THD2; ADHEr, G6PDHy, MDH, THD2; ADHEr, PFLi, PPCK, THD2; ADHEr, ACKr, AKGD, ATPS4r; ADHEr, GLCpts, PFLi, PPCK; ADHEr, ACKr, ATPS4r, SUCOAS; ADHEr, GLUDy, PFLi, PPCK; ADHEr, ME2, PFLi, SUCD4; ADHEr, GLUDy, PFLi, SUCD4; ADHEr, ATPS4r, LDH_D, SUCD4; ADHEr, FUM, HEX1, PFLi; ADHEr, MDH, NADH6, THD2; ADHEr, ATPS4r, MDH, NADH6; ADHEr, ATPS4r, FUM, NADH6; ADHEr, ASPT, MDH, NADH6; ADHEr, ASPT, MDH, THD2; ADHEr, ATPS4r, GLCpts, SUCD4; ADHEr, ATPS4r, GLUDy, MDH; ADHEr, ATPS4r, MDH, PPCK; ADHEr, ATPS4r, FUM, PPCK; ADHEr, ASPT, GLCpts, MDH; ADHEr, ASPT, GLUDy, MDH; ADHEr, ME2, SUCD4, THD2; ADHEr, FUM, PPCK, THD2; ADHEr, MDH, PPCK, THD2; ADHEr, GLUDy, MDH, THD2; ADHEr, HEX1, PFLi, THD2; ADHEr, ATPS4r, G6PDHy, MDH; ADHEr, ATPS4r, MDH, PGL; ADHEr, ACKr, FRD2, LDH_D; ADHEr, ACKr, LDH_D, SUCD4; ADHEr, ATPS4r, FUM, GLUDy; ADHEr, ATPS4r, FUM, HEX1; ADHEr, ATPS4r, MDH, THD2; ADHEr, ATPS4r, FRD2, LDH_D; ADHEr, ATPS4r, MDH, PGDH; ADHEr, GLCpts, PPCK, THD2; ADHEr, GLUDy, PPCK, THD2; ADHEr, FUM, HEX1, THD2; ADHEr, ATPS4r, ME2, THD2; ADHEr, FUM, ME2, THD2; ADHEr, GLCpts, GLUDy, PPCK; ADHEr, ME2, PGL, THD2; ADHEr, G6PDHy, ME2, THD2; ADHEr, ATPS4r, FRD2, LDH_D, ME2; ADHEr, ATPS4r, FRD2, LDH_D, MDH; ADHEr, ASPT, LDH_D, MDH, PFLi; ADHEr, ATPS4r, GLCpts, NADH6, PFLi; ADHEr, ATPS4r, MDH, NADH6, PGL; ADHEr, ATPS4r, G6PDHy, MDH, NADH6; ADHEr, ACKr, FUM, GLUDy, LDH_D; ADHEr, ACKr, GLUDy, LDH_D, SUCD4; ADHEr, ATPS4r, G6PDHy, MDH, THD2; ADHEr, ATPS4r, MDH, PGL, THD2; ADHEr, ASPT, G6PDHy, MDH, PYK; ADHEr, ASPT, MDH, PGL, PYK; ADHEr, ASPT, LDH_D, MDH, SUCOAS; ADHEr, ASPT, FUM, LDH_D, MDH; ADHEr, ASPT, LDH_D, MALS, MDH; ADHEr, ASPT, ICL, LDH_D, MDH; ADHEr, FRD2, GLUDy, LDH_D, PPCK; ADHEr, FRD2, LDH_D, PPCK, THD2; ADHEr, ACKr, ATPS4r, LDH_D, SUCD4; ADHEr, ACKr, ACS, PPC, PPCK; ADHEr, GLUDy, LDH_D, PPC, PPCK; ADHEr, LDH_D, PPC, PPCK, THD2; ADHEr, ASPT, ATPS4r, GLCpts, MDH; ADHEr, G6PDHy, MDH, NADH6, THD2; ADHEr, MDH, NADH6, PGL, THD2; ADHEr, ATPS4r, G6PDHy, GLCpts, MDH; ADHEr, ATPS4r, GLCpts, MDH, PGL; ADHEr, ACKr, LDH_D, MDH, SUCD4.

Table 19 shows the reactions of corresponding genes to be knocked out of a host organism such as *E. coli*. The corresponding metabolite corresponding to abbreviations in Table 19 are shown in Table 20.

TABLE 19

Corresponding genes to be knocked out to prevent a particular reaction from occurring in *E. coli*.

| Reaction Abbreviation | Reaction Stoichiometry* | Genes Encoding the Enzyme(s) Catalyzing Each Reaction & |
|---|---|---|
| ACKr | [c]: ac + atp <==> actp + adp | (b3115 or b2296 or b1849) |
| ACS | [c]: ac + atp + coa --> accoa + amp + ppi | b4069 |
| ACt6 | ac[p] + h[p] <==>ac[c] + h[c] | Non-gene associated |
| ADHEr | [c]: etoh + nad <==> acald + h + nadh | (b0356 or b1478 or b1241) |
|  | [c]: acald + coa + nad <==> accoa + h + nadh | (b1241 or b0351) |
| AKGD | [c]: akg + coa + nad --> co2 + nadh + succoa | (b0116 and b0726 and b0727) |
| ASNS2 | [c]: asp-L + atp + nh4 --> amp + asn-L + h + ppi | b3744 |
| ASPT | [c]: asp-L --> fum + nh4 | b4139 |
| ATPS4r | adp[c] + (4) h[p] + pi[c] <==> atp[c] + (3) h[c] + h2o[c] | (((b3736 and b3737 and b3738) and (b3731 and b3732 and b3733 and b3734 and b3735)) or ((b3736 and b3737 and b3738) and (b3731 and b3732 and b3733 and b3734 and b3735) and b3739)) |
| CBMK2 | [c]: atp + co2 + nh4 <==> adp + cbp + (2) h | (b0521 or b0323 or b2874) |
| EDA | [c]: 2ddg6p --> g3p + pyr | b1850 |
| ENO | [c]: 2pg <==> h2o + pep | b2779 |
| FBA | [c]: fdp <==> dhap + g3p | (b2097 or b2925 or b1773) |
| FBP | [c]: fdp + h2o --> f6p + pi | (b4232 or b3925) |
| FDH2 | for[p] + (2) h[c] + q8[c] --> co2[c] + h[p] + q8h2[c] | ((b3892 and b3893 and b3894) |
|  | for[p] + (2) h[c] + mqn8[c] --> co2[c] + h[p] + mql8[c] | or (b1474 and b1475 and b1476)) |

TABLE 19-continued

Corresponding genes to be knocked out to prevent a particular reaction from occurring in E. coli.

| Reaction Abbreviation | Reaction Stoichiometry* | Genes Encoding the Enzyme(s) Catalyzing Each Reaction & |
|---|---|---|
| FRD2 | [c]: fum + mql8 --> mqn8 + succ<br>[c]: 2dmmql8 + fum --> 2dmmq8 + succ | (b4151 and b4152 and b4153 and b4154) |
| FTHFD | [c]: 10fthf + h2o --> for + h + thf | b1232 |
| FUM | [c]: fum + h2o <==> mal-L | (b1612 or b4122 or b1611) |
| G5SD | [c]: glu5p + h + nadph --> glu5sa + nadp + pi | b0243 |
| G6PDHy | [c]: g6p + nadp <==> 6pgl + h + nadph | b1852 |
| GLCpts | glc-D[p] + pep[c] --> g6p[c] + pyr[c] | ((b2417 and b1101 and b2415 and b2416) or (b1817 and b1818 and b1819 and b2415 and b2416) or (b2417 and b1621 and b2415 and b2416)) |
| GLU5K | [c]: atp + glu-L --> adp + glu5p | b0242 |
| GLUDy | [c]: glu-L + h2o + nadp <==> akg + h + nadph + nh4 | b1761 |
| GLYCL | [c]: gly + nad + thf --> co2 + mlthf + nadh + nh4 | (b2904 and b2903 and b2905 and b0116) |
| HEX1 | [c]: atp + glc-D --> adp + g6p + h | b2388 |
| ICL | [c]: icit --> glx + succ | b4015 |
| LDH_D | [c]: lac-D + nad <==> h + nadh + pyr | (b2133 or b1380) |
| MALS | [c]: accoa + glx + h2o --> coa + h + mal-L | (b4014 or b2976) |
| MPH | [c]: mal-L + nad <==> h + nadh + oaa | b3236 |
| ME2 | [c]: mal-L + nadp --> co2 + nadph + pyr | b2463 |
| MTHFC | [c]: h2o + methf <==> 10fthf + h | b0529 |
| NADH12 | [c]: h + mqn8 + nadh --> mql8 + nad<br>[c]: h + nadh + q8 --> nad + q8h2<br>[c]: 2dmmq8 + h + nadh --> 2dmmql8 + nad | b1109 |
| NADH6 | (4) h[c] + nadh[c] + q8[c] --> (3) h[p] + nad[c] + q8h2[c]<br>(4) h[c] + mqn8[c] + nadh[c] --> (3) h[p] + mql8[c] + nad[c]<br>2dmmq8[c] + (4) h[c] + nadh[c] --> 2dmmql8[c] + (3) h[p] +nad[c] | (b2276 and b2277 and b2278 and b2279 and b2280 and b2281 and b2282 and b2283 and b2284 and b2285 and b2286 and b2287 and b2288) |
| PFK | [c]: atp + f6p --> adp + fdp + h | (b3916 or b1723) |
| PFLi | [c]: coa + pyr --> accoa + for | (((b0902 and b0903) and b2579) or (b0902 and b0903) or (b0902 and b3114) or (b3951 and b3952)) |
| PGDH | [c]: 6pgc + nadp --> co2 + nadph + ru5p-D | b2029 |
| PGI | [c]: g6p <==> f6p | b4025 |
| PGL | [c]: 6pgl + h2o --> 6pgc + h | b0767 |
| PGM | [c]: 2pg <==> 3pg | (b3612 or b4395 or b0755) |
| PPC | [c]: co2 + h2o + pep --> h + oaa + pi | b3956 |
| PPCK | [c]: atp + oaa --> adp + co2 + pep | b3403 |
| PRO1z | [c]: fad + pro-L --> 1pyr5c + fadh2 + h | b1014 |
| PYK | [c]: adp + h + pep --> atp + pyr | b1854 or b1676) |
| PYRt2 | h[p] + pyr[p] <==> h[c] + pyr[c] | Non-gene associated |
| RPE | [c]: ru5p-D <==> xu5p-D | (b4301 or b3386) |
| SO4t2 | so4[e] <==> so4[p] | (b0241 or b0929 or b1377 or b2215) |
| SUCD4 | [c]: q8 + succ --> fum + q8h2 | (b0721 and b0722 and b0723 and b0724) |
| SUCOAS | [c]: atp + coa + succ <==> adp + pi + succoa | (b0728 and b0729) |
| SULabc | atp[c] + h2o[c] + so4[p] --> adp[c] + h[c] + pi[c] + so4[c] | ((b2422 and b2425 and b2424 and b2423) or (b0763 and b0764 and b0765) or (b2422 and b2424 and b2423 and b3917)) |
| TAL | [c]: g3p + s7p <==> e4p + f6p | (b2464 or b0008) |
| THD2 | (2) h[p] + nadh[c] + nadp[c] --> (2) h[c] + nad[c] + nadph[c] | (b1602 and b1603) |
| THD5 | [c]: nad + nadph --> nadh + nadp | (b3962 or (b1602 and b1603)) |
| TPI | [c]: dhap <==> g3p | b3919 |

TABLE 20

Metabolite names corresponding to abbreviations used in Table 19.

| Metabolite Abbreviation | Metabolite Name |
|---|---|
| 10fthf | 10-Formyltetrahydrofolate |
| 1pyr5c | 1-Pyrroline-5-carboxylate |
| 2ddg6p | 2-Dehydro-3-deoxy-D-gluconate 6-phosphate |
| 2dmmq8 | 2-Demethylmenaquinone 8 |
| 2dmmql8 | 2-Demethylmenaquinol 8 |
| 2pg | D-Glycerate 2-phosphate |

TABLE 20-continued

Metabolite names corresponding to abbreviations used in Table 19.

| Metabolite Abbreviation | Metabolite Name |
|---|---|
| 3pg | 3-Phospho-D-glycerate |
| 6pgc | 6-Phospho-D-gluconate |
| 6pgl | 6-phospho-D-glucono-1,5-lactone |
| ac | Acetate |
| acald | Acetaldehyde |
| accoa | Acetyl-CoA |
| actp | Acetyl phosphate |
| adp | ADP |
| akg | 2-Oxoglutarate |
| amp | AMP |
| asn-L | L-Asparagine |
| asp-L | L-Aspartate |
| atp | ATP |
| cbp | Carbamoyl phosphate |
| co2 | CO2 |
| coa | Coenzyme A |
| dhap | Dihydroxyacetone phosphate |
| e4p | D-Erythrose 4-phosphate |
| etoh | Ethanol |
| f6p | D-Fructose 6-phosphate |
| fad | Flavin adenine dinucleotide oxidized |
| fadh2 | Flavin adenine dinucleotide reduced |
| fdp | D-Fructose 1,6-bisphosphate |
| for | Formate |
| fum | Fumarate |
| g3p | Glyceraldehyde 3-phosphate |
| g6p | D-Glucose 6-phosphate |
| glc-D | D-Glucose |
| glu5p | L-Glutamate 5-phosphate |
| glu5sa | L-Glutamate 5-semialdehyde |
| glu-L | L-Glutamate |
| glx | Glyoxylate |
| gly | Glycine |
| h | H+ |
| h2o | H2O |
| icit | Isocitrate |
| lac-D | D-Lactate |
| mal-L | L-Malate |
| methf | 5,10-Methenyltetrahydrofolate |
| mlthf | 5,10-Methylenetetrahydrofolate |
| mql8 | Menaquinol 8 |
| mqn8 | Menaquinone 8 |
| nad | Nicotinamide adenine dinucleotide |
| nadh | Nicotinamide adenine dinucleotide-reduced |
| nadp | Nicotinamide adenine dinucleotide phosphate |
| nadph | Nicotinamide adenine dinucleotide phosphate-reduced |
| nh4 | Ammonium |
| oaa | Oxaloacetate |
| pep | Phosphoenolpyruvate |
| pi | Phosphate |
| ppi | Diphosphate |
| pro-L | L-Proline |
| pyr | Pyruvate |
| q8 | Ubiquinone-8 |
| q8h2 | Ubiquinol-8 |
| ru5p-D | D-Ribulose 5-phosphate |
| s7p | Sedoheptulose 7-phosphate |
| so4 | Sulfate |
| succ | Succinate |
| succoa | Succinyl-CoA |
| thf | 5,6,7,8-Tetrahydrofolate |
| xu5p-D | D-Xylulose 5-phosphate |

Example XX

Exemplary Pathways for Producing BDO

This example describes exemplary pathways to produce 4-hydroxybutanal (4-HBal) and/or BDO using a carboxylic acid reductase as a BDO pathway enzyme. See corresponding example in WO2013/186402. 4-Hydroxybutyrate can be derived from the tricarboxylic acid cycle intermediates succinyl-CoA and/or alpha-ketoglutarate as shown in FIG. 58.

Example XXI

Biosynthesis of 1,4-Butanediol Using a Carboxylic Acid Reductase Enzyme

Figure 61:
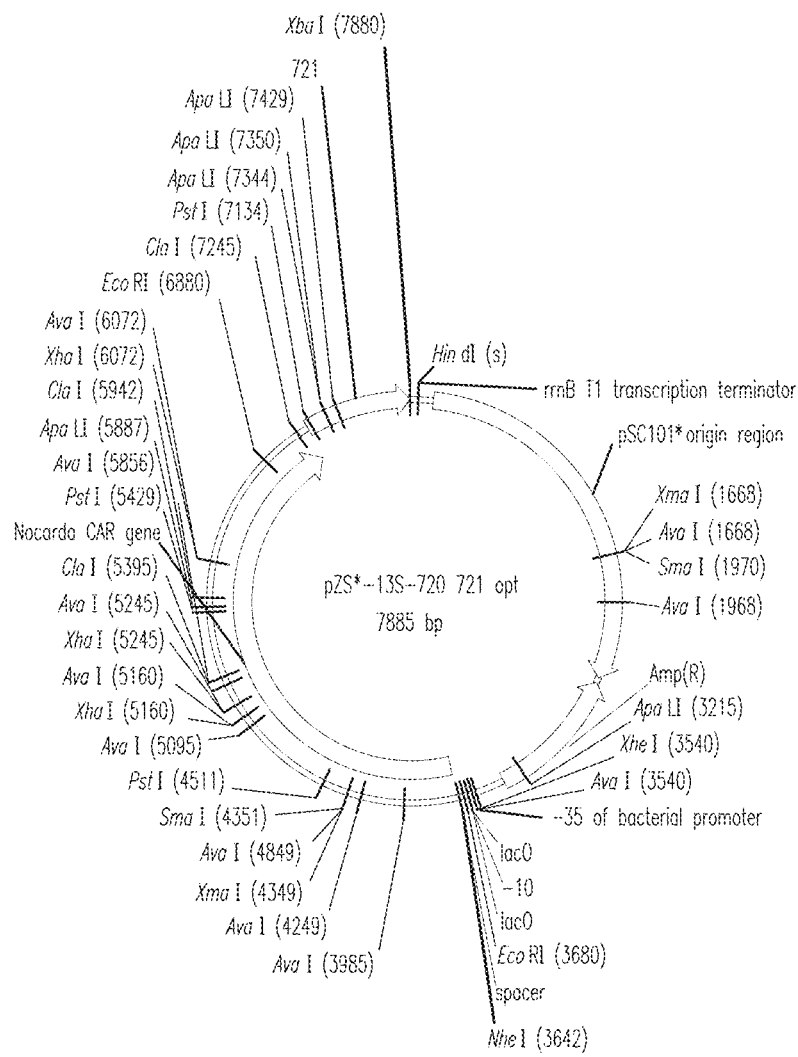
FIG. 61 shows a plasmid map of plasmid pZS*-13S-720 721opt.

This example describes the generation of a microbial organism that produces 1,4-butanediol using a carboxylic acid reductase enzyme. See corresponding example in WO2013/186402. The car gene (GNM_720) was cloned by PCR from *Nocardia* genomic DNA. Its nucleic acid and protein sequences are shown in FIGS. 59A and 59B, respectively. A codon-optimized version of the npt gene (GNM_721) was synthesized. Its nucleic acid and protein sequences are shown in FIGS. 60A and 60B, respectively. The resulting vector from cloning GNM_720 and GNM_721 into pZS*13 is shown in FIG. 61. Additional pathways to BDO employing carboxylic acid reductase (CAR) are disclosed in FIG. 62.

Example XXII

Pathways to Putrescine that Employ Carboxylic Acid Reductase

This example describes exemplary putrescine pathways utilizing carboxylic acid reductase. See corresponding example in WO2013/186402. FIG. 63 describes a number of additional biosynthetic pathways leading to the production of putrescine from succinate, succinyl-CoA, or alpha-ketoglutarate and employing a carboxylic acid reductase.

Example XXIII

Exemplary Enzymes for Production of C4 Compounds

This example describes exemplary enzymes for production of C4 compounds such as 1,4-butanediol, 4-hydroxybutanal and putrescine. See corresponding example in WO2013/186402.

Enzyme Classes.

All transformations depicted in FIGS. 58, 62 and 63 fall into the general categories of transformations shown in Table 21. This example describes a number of biochemically characterized genes in each category. Specifically listed are genes that can be applied to catalyze the appropriate transformations in FIGS. 58, 62 and 63 when cloned and expressed. The first three digits of each label correspond to the first three Enzyme Commission number digits which denote the general type of transformation independent of substrate specificity.

TABLE 21

Classes of Enzyme Transformations Depicted in FIGS. 58, 62 and 63.

| LABEL | FUNCTION |
|---|---|
| 1.1.1.a | Oxidoreductase (oxo to alcohol) |
| 1.1.1.c | Oxidoreductase (2 step, acyl-CoA to alcohol) |
| 1.2.1.b | Oxidoreductase (acyl-CoA to aldehyde) |
| 1.2.1.c | Oxidoreductase (2-oxo acid to acyl-CoA, decarboxylation) |
| 1.2.1.d | Oxidoreductase (phosphonate reductase) |
| 1.2.1.e | Acid reductase |
| 1.4.1.a | Oxidoreductase (aminating) |
| 2.3.1.a | Acyltransferase (transferring phosphate group to CoA) |
| 2.6.1.a | Aminotransferase |

TABLE 21-continued

Classes of Enzyme Transformations Depicted in FIGS. 58, 62 and 63.

| LABEL | FUNCTION |
|---|---|
| 2.7.2.a | Phosphotransferase (carboxy acceptor) |
| 2.8.3.a | CoA transferase |
| 3.1.2.a | CoA hydrolase |
| 4.1.1.a | Carboxy-lyase |
| 6.2.1.a | CoA synthetase |

1.1.1.a Oxidoreductase (Oxo to Alcohol)
Aldehyde to Alcohol.

Three transformations described in FIGS. 58, 62 and 63 involve the conversion of an aldehyde to alcohol. These are 4-hydroxybutyrate dehydrogenase (step C, FIGS. 58 and 62), 1,4-butanediol dehydrogenase (step E, FIGS. 58 and 62), and 5-hydroxy-2-pentanoic acid (step Y, FIG. 62). Exemplary genes encoding enzymes that catalyze the conversion of an aldehyde to alcohol, that is, alcohol dehydrogenase or equivalently aldehyde reductase, include those recited above in EXAMPLE IV Exemplary BDO Pathways.

Enzymes exhibiting 4-hydroxybutyrate dehydrogenase activity (EC 1.1.1.61) also fall into this category. The description and enzymes for this example can be found in the above EXAMPLE IV Exemplary BDO Pathways.

The adh1 gene from *Geobacillus thermoglucosidasius* M10EXG (Jeon et al., *J. Biotechnol.* 135:127-133 (2008)) was shown to exhibit high activity on both 4-hydroxybutanal and butanal (see above). Thus this enzyme exhibits 1,4-butanediol dehydrogenase activity.

| Gene | Accession No. | GI No. | Organism |
|---|---|---|---|
| adh1 | AAR91477.1 | 40795502 | *Geobacillus thermoglucosidasius* M10EXG |

Another exemplary enzyme is 3-hydroxyisobutyrate dehydrogenase, which catalyzes the reversible oxidation of 3-hydroxyisobutyrate to methylmalonate semialdehyde. The description and enzymes for this example can be found in the above EXAMPLE IV Exemplary BDO Pathways. Several 3-hydroxyisobutyrate dehydrogenase enzymes have also been shown to convert malonic semialdehyde to 3-hydroxypropionic acid (3-HP). The description and enzymes for this example can be found in the above EXAMPLE IV Exemplary BDO Pathways.

The conversion of malonic semialdehyde to 3-HP can also be accomplished by two other enzymes, NADH-dependent 3-hydroxypropionate dehydrogenase and NADPH-dependent malonate semialdehyde reductase. The description and enzymes for this example can be found in the above EXAMPLE IV Exemplary BDO Pathways.

1.1.1.c Oxidoreductase (2 Step, Acyl-CoA to Alcohol).

Steps S and W of FIG. 62 depict bifunctional reductase enzymes that can form 4-hydroxybutyrate and 1,4-butanediol, respectively. Exemplary 2-step oxidoreductases that convert an acyl-CoA to alcohol include those that transform substrates such as acetyl-CoA to ethanol (for example, adhE from *E. coli* (Kessler et al., *FEBS. Lett.* 281:59-63 (1991)) and butyryl-CoA to butanol (for example, adhE2 from *C. acetobutylicum* (Fontaine et al., *J. Bacteriol.* 184:821-830 (2002)). The *C. acetobutylicum* adhE2 gene was shown to convert 4-hydroxybutyryl-CoA to 1,4-butanediol (see above). In addition to reducing acetyl-CoA to ethanol, the enzyme encoded by adhE in *Leuconostoc mesenteroides* has been shown to oxidize the branched chain compound isobutyraldehyde to isobutyryl-CoA (Kazahaya et al. *J., Gen. Appl. Microbiol.* 18:43-55 (1972); Koo et al., *Biotechnol. Lett.* 27:505-510 (2005)).

| Gene | Accession No. | GI No. | Organism |
|---|---|---|---|
| adhE | NP_415757.1 | 16129202 | *Escherichia coli* |
| adhE2 | AAK09379.1 | 12958626 | *Clostridium acetobutylicum* |
| adhE | AAV66076.1 | 55818563 | *Leuconostoc mesenteroides* |

Another exemplary enzyme can convert malonyl-CoA to 3-HP The description and enzymes for this example can be found in the above EXAMPLE IV Exemplary BDO Pathways.

Longer chain acyl-CoA molecules can be reduced by enzymes such as the jojoba (*Simmondsia chinensis*) FAR, which encodes an alcohol-forming fatty acyl-CoA reductase. Its overexpression in *E. coli* resulted in FAR activity and the accumulation of fatty alcohol (Metz et al., *Plant Physiol.* 122:635-644 2000).

| Gene | Accession No. | GI No. | Organism |
|---|---|---|---|
| FAR | AAD38039.1 | 5020215 | *Simmondsia chinensis* |

1.2.1.b Oxidoreductase (Acyl-CoA to Aldehyde).

Step A of FIGS. 58, 62 and 63 involves the conversion of succinyl-CoA to succinate semialdehyde by an aldehyde forming succinyl-CoA reductase. Step Q of FIG. 62 depicts the conversion of 4-hydroxybutyryl-CoA to 4-hydroxybutanal by an aldehyde-forming 4-hydroxybutyryl-CoA reductase. A description and enzymes of this class can be found in above Example IV Exemplary BDO Pathways. In addition to reducing acetyl-CoA to ethanol, the enzyme encoded by adhE in *Leuconostoc mesenteroides* has been shown to oxidize the branched chain compound isobutyraldehyde to isobutyryl-CoA (Koo et al., *Biotechnol. Lett.* 27:505-510 (2005)). Butyraldehyde dehydrogenase catalyzes a similar reaction, conversion of butyryl-CoA to butyraldehyde, in solventogenic organisms such as *Clostridium Ssaccharoperbutylacetonicum* (Kosaka et al, *Biosci. Biotechnol. Biochem.* 71:58-68 (2007)).

| Gene | Accession No. | GI No. | Organism |
|---|---|---|---|
| acr1 | YP_047869.1 | 50086359 | *Acinetobacter calcoaceticus* |
| acr1 | AAC45217 | 1684886 | *Acinetobacter baylyi* |
| acr1 | BAB85476.1 | 18857901 | *Acinetobacter* sp. Strain M-1 |
| sucD | P38947.1 | 730847 | *Clostridium kluyveri* |
| sucD | NP_904963.1 | 34540484 | *Porphyromonas gingivalis* |
| bphG | BAA03892.1 | 425213 | *Pseudomonas* sp |
| adhE | AAV66076.1 | 55818563 | *Leuconostoc mesenteroides* |
| bld | AAP42563.1 | 31075383 | *Clostridium saccharoperbutylacetonicum* |

An additional enzyme type that converts an acyl-CoA to its corresponding aldehyde is malonyl-CoA reductase, which transforms malonyl-CoA to malonic semialdehyde. A description and enzymes of this class can be found in above Example IV Exemplary BDO Pathways. Yet another candidate for CoA-acylating aldehyde dehydrogenase is the ald gene from *Clostridium beijerinckii* (Toth et al., *Appl. Environ Microbiol.* 65:4973-4980 (1999)). This enzyme has been reported to reduce acetyl-CoA and butyryl-CoA to their corresponding aldehydes. This gene is very similar to eutE that encodes acetaldehyde dehydrogenase of *Salmonella typhimurium* and *E. coli* (Toth et al., *Appl. Environ. Microbiol.* 65:4973-4980 (1999)).

| Gene | Accession No. | GI No. | Organism |
| --- | --- | --- | --- |
| Msed_0709 | YP_001190808.1 | 146303492 | *Metallosphaera sedula* |
| mcr | NP_378167.1 | 15922498 | *Sulfolobus tokodaii* |
| asd-2 | NP_343563.1 | 15898958 | *Sulfolobus solfataricus* |
| Saci_2370 | YP_256941.1 | 70608071 | *Sulfolobus acidocaldarius* |
| Ald | AAT66436 | 49473535 | *Clostridium beijerinckii* |
| eutE | AAA80209 | 687645 | *Salmonella typhimurium* |
| eutE | P77445 | 2498347 | *Escherichia coli* |

1.2.1.c Oxidoreductase (2-Oxo Acid to Acyl-CoA, Decarboxylation).

Step AA in FIG. 62 depicts the conversion of 5-hydroxy-2-oxopentanoic acid to 4-hydroxybutyryl-CoA. Candidate enzymes for this transformation include 1) branched-chain 2-keto-acid dehydrogenase, 2) alpha-ketoglutarate dehydrogenase, and 3) the pyruvate dehydrogenase multienzyme complex (PDHC). A description and enzymes of this class can be found in above Example IV Exemplary BDO Pathways.

Alpha-ketoglutarate dehydrogenase (AKGD) converts alpha-ketoglutarate to succinyl-CoA and is the primary site of control of metabolic flux through the TCA cycle (Hansford, R. G *Curr. Top. Bioenerg.* 10:217-278 (1980)). A description and enzymes of this class can be found in above Example IV Exemplary BDO Pathways.

Branched-chain 2-keto-acid dehydrogenase complex (BCKAD), also known as 2-oxoisovalerate dehydrogenase, participates in branched-chain amino acid degradation pathways, converting 2-keto acids derivatives of valine, leucine and isoleucine to their acyl-CoA derivatives and C02. A description and enzymes of this class can be found in above Example IV Exemplary BDO Pathways.

The pyruvate dehydrogenase complex, catalyzing the conversion of pyruvate to acetyl-CoA, has also been extensively studied. In the *E. coli* enzyme, specific residues in the E1 component are responsible for substrate specificity (Bisswanger, H. *J Biol Chem.* 256:815-822 (1981); Bremer, J. *Eur. J Biochem.* 8:535-540 (1969); Gong et al. *J Biol Chem.* 275:13645-13653 (2000)). A description and enzymes of this class can be found in above Example IV Exemplary BDO Pathways.

As an alternative to the large multienzyme 2-keto-acid dehydrogenase complexes described above, some anaerobic organisms utilize enzymes in the 2-ketoacid oxidoreductase family (OFOR) to catalyze acylating oxidative decarboxylation of 2-keto-acids. A description and enzymes of this class can be found in above Example IV Exemplary BDO Pathways.

1.2.1.d Oxidoreductase (Phosphonate Reductase).

The conversion of 4-hydroxybutyryl-phosphate to 4-hydroxybutanal can be catalyzed by an oxidoreductase in the EC class 1.2.1. Aspartate semialdehyde dehydrogenase (ASD, EC 1.2.1.11) catalyzes the NADPH-dependent reduction of 4-aspartyl phosphate to aspartate-4-semialdehyde. ASD participates in amino acid biosynthesis and recently has been studied as an antimicrobial target (Hadfield et al., *Biochemistry* 40:14475-14483 (2001). The *E. coli* ASD structure has been solved (Hadfield et al., *J. Mol. Biol.* 289:991-1002 (1999)) and the enzyme has been shown to accept the alternate substrate beta-3-methylaspartyl phosphate (Shames et al., *J. Biol. Chem.* 259:15331-15339 (1984)). The *Haemophilus influenzae* enzyme has been the subject of enzyme engineering studies to alter substrate binding affinities at the active site (Blanco et al., *Acta Crystallogr. D. Biol. Crystallogr.* 60:1388-1395 (2004); Blanco et al., *Acta Crystallogr. D. Biol. Crystallogr.* 60:1808-1815 (2004)). Other ASD candidates are found in *Mycobacterium tuberculosis* (Shafiani et al., *J. Appl. Microbiol.* 98:832-838 (2005), *Methanococcus jannaschii* (Faehnle et al., *J. Mol. Biol.* 353:1055-1068 (2005)), and the infectious microorganisms *Vibrio cholera* and *Heliobacter pylori* (Moore et al., *Protein Expr Purif* 25:189-194 (2002)). A related enzyme candidate is acetylglutamylphosphate reductase (EC 1.2.1.38), an enzyme that naturally reduces acetylglutamylphosphate to acetylglutamate-5-semialdehyde, found in *S. cerevisiae* (Pauwels et al., *Eur. J. Biochem.* 270:1014-1024 (2003), *B. subtilis* (O'Reilly and Devine, *Microbiology* 140 (Pt 5):1023-1025 (1994)). and other organisms.

| Gene | Accession No. | GI No. | Organism |
| --- | --- | --- | --- |
| asd | NP_417891.1 | 16131307 | *Escherichia coli* |
| asd | YP_248335.1 | 68249223 | *Haemophilus influenzae* |
| asd | AAB49996 | 1899206 | *Mycobacterium tuberculosis* |
| VC2036 | NP_231670 | 15642038 | *Vibrio cholera* |
| asd | YP_002301787.1 | 210135348 | *Heliobacter pylori* |
| ARG5,6 | NP_010992.1 | 6320913 | *Saccharomyces cerevisiae* |
| argC | NP_389001.1 | 16078184 | *Bacillus subtilis* |

Other exemplary enzymes in this class include glyceraldehyde 3-phosphate dehydrogenase which converts glyceraldehyde-3-phosphate into D-glycerate 1,3-bisphosphate (for example, *E. coli* gapA (Branlant and Branlant, *Eur. J. Biochem.* 150:61-66 (1985)), N-acetyl-gamma-glutamylphosphate reductase which converts N-acetyl-L-glutamate-5-semialdehyde into N-acetyl-L-glutamyl-5-phosphate (for example, *E. coli* argC (Parsot et al., *Gene* 68:275-283 (1988)), and glutamate-5-semialdehyde dehydrogenase, which converts L-glutamate-5-semialdehyde into L-glutamyl-5-phospate (for example, *E. coli* proA (Smith et al., *J. Bacteriol* 157:545-551 (1984)). Genes encoding glutamate-5-semialdehyde dehydrogenase enzymes from *Salmonella typhimurium* (Mahan and Csonka, *J. Bacteriol.* 156:1249-1262 (1983)) and *Campylobacter jejuni* (Louie and Chan, *Mol. Gen Genet.* 240:29-35 (1993)) were cloned and expressed in *E. coli*.

| Gene | Accession No. | GI No. | Organism |
| --- | --- | --- | --- |
| gapA | P0A9B2.2 | 71159358 | *Escherichia coli* |
| argC | NP_418393.1 | 16131796 | *Escherichia coli* |
| proA | NP_414778.1 | 16128229 | *Escherichia coli* |
| proA | NP_459319.1 | 16763704 | *Salmonella typhimurium* |
| proA | P53000.2 | 9087222 | *Campylobacter jejuni* |

1.2.1.e Acid Reductase.

Several steps in FIGS. 58, 62 and 63 depict the conversion of unactivated acids to aldehydes by an acid reductase. These include the conversion of 4-hydroxybutyrate, succinate, alpha-ketoglutarate, and 4-aminobutyrate to 4-hydroxybutanal, succinate semialdehyde, 2,5-dioxopentanoate, and 4-aminobutanal, respectively. One notable carboxylic acid reductase can be found in *Nocardia iowensis* which catalyzes the magnesium, ATP and NADPH-dependent reduction of carboxylic acids to their corresponding aldehydes (Venkitasubramanian et al., *J. Biol. Chem.* 282: 478-485 (2007)). This enzyme is encoded by the car gene and was cloned and functionally expressed in *E. coli* (Venkitasubramanian et al., *J. Biol. Chem.* 282:478-485 (2007)). Expression of the npt gene product improved activity of the enzyme via post-transcriptional modification. The npt gene encodes a specific phosphopantetheine transferase (PPTase) that converts the inactive apo-enzyme to the active holo-enzyme. The natural substrate of this enzyme is vanillic acid, and the enzyme exhibits broad acceptance of aromatic and aliphatic substrates (Venkitasubramanian et al., in *Biocatalysis in the Pharmaceutical and Biotechnology Industries*, ed. R. N. Patel, Chapter 15, pp. 425-440, CRC Press LLC, Boca Raton, FL (2006)).

| Gene | Accession No. | GI No. | Organism |
|---|---|---|---|
| car | AAR91681.1 | 40796035 | Nocardia iowensis (sp. NRRL 5646) |
| npt | ABI83656.1 | 114848891 | Nocardia iowensis (sp. NRRL 5646) |

Additional car and npt genes can be identified based on sequence homology.

TABLE 23

| Gene | Accession No. | GI No. | Organism |
|---|---|---|---|
| fadD9 | YP_978699.1 | 121638475 | Mycobacterium bovis BCG |
| BCG_2812c | YP_978898.1 | 121638674 | Mycobacterium bovis BCG |
| nfa20150 | YP_118225.1 | 54023983 | Nocardia farcinica IFM 10152 |
| nfa40540 | YP_120266.1 | 54026024 | Nocardia farcinica IFM 10152 |
| SGR_6790 | YP_001828302.1 | 182440583 | Streptomyces griseus subsp. griseus NBRC 13350 |
| SGR_665 | YP_001822177.1 | 182434458 | Streptomyces griseus subsp. griseus NBRC 13350 |

An additional enzyme candidate found in *Streptomyces griseus* is encoded by the griC and griD genes. This enzyme is believed to convert 3-amino-4-hydroxybenzoic acid to 3-amino-4-hydroxybenzaldehyde as deletion of either griC or griD led to accumulation of extracellular 3-acetylamino-4-hydroxybenzoic acid, a shunt product of 3-amino-4-hydroxybenzoic acid metabolism (Suzuki, et al., *J Antibiot.* 60(6):380-387 (2007)). Co-expression of griC and griD with SGR_665, an enzyme similar in sequence to the *Nocardia iowensis* npt, can be beneficial.

| Gene | Accession No. | GI No. | Organism |
|---|---|---|---|
| griC | 182438036 | YP_001825755.1 | Streptomyces griseus subsp. griseus NBRC 13350 |
| griD | 182438037 | YP_001825756.1 | Streptomyces griseus subsp. griseus NBRC 13350 |
| MSMEG_2956 | YP_887275.1 | YP_887275.1 | Mycobacterium smegmatis MC2 155 |
| MSMEG_5739 | YP_889972.1 | 118469671 | Mycobacterium smegmatis MC2 155 |
| MSMEG_2648 | YP_886985.1 | 118471293 | Mycobacterium smegmatis MC2 155 |
| MAP1040c | NP_959974.1 | 41407138 | Mycobacterium avium subsp. paratuberculosis K-10 |
| MAP2899c | NP_961833.1 | 41408997 | Mycobacterium avium subsp. paratuberculosis K-10 |
| MMAR_2117 | YP_001850422.1 | 183982131 | Mycobacterium marinum M |
| MMAR_2936 | YP_001851230.1 | 183982939 | Mycobacterium marinum M |
| MMAR_1916 | YP_001850220.1 | 183981929 | Mycobacterium marinum M |
| TpauDRAFT_33060 | ZP_04027864.1 | 227980601 | Tsukamurella paurometabola DSM 20162 |
| TpauDRAFT_20920 | ZP_04026660.1 | 227979396 | Tsukamurella paurometabola DSM 20162 |
| CPCC7001_1320 | ZP_05045132.1 | 254431429 | Cyanobium PCC7001 |
| DDBDRAFT_0187729 | XP_636931.1 | 66806417 | Dictyostelium discoideum AX4 |

An enzyme with similar characteristics, alpha-aminoadipate reductase (AAR, EC 1.2.1.31), participates in lysine biosynthesis pathways in some fungal species. This enzyme naturally reduces alpha-aminoadipate to alpha-aminoadipate semialdehyde. The carboxyl group is first activated through the ATP-dependent formation of an adenylate that is then reduced by NAD(P)H to yield the aldehyde and AMP. Like CAR, this enzyme utilizes magnesium and requires activation by a PPTase. Enzyme candidates for AAR and its corresponding PPTase are found in *Saccharomyces cerevisiae* (Morris et al., *Gene* 98:141-145 (1991)), *Candida albicans* (Guo et al., *Mol. Genet. Genomics* 269:271-279 (2003)), and *Schizosaccharomyces pombe* (Ford et al., *Curr Genet.* 28:131-137 (1995)). The AAR from *S. pombe* exhibited significant activity when expressed in *E. coli* (Guo et al., *Yeast* 21:1279-1288 (2004)). The AAR from *Penicillium chrysogenum* accepts S-carboxymethyl-L-cysteine as an alternate substrate, but did not react with adipate, L-glutamate or diaminopimelate (Hijarrubia et al., *J. Biol. Chem.* 278:8250-8256 (2003)). The gene encoding the *P. chrysogenum* PPTase has not been identified to date.

| Gene | Accession No. | GI No. | Organism |
|---|---|---|---|
| LYS2 | AAA34747.1 | 171867 | Saccharomyces cerevisiae |
| LYS5 | P50113.1 | 1708896 | Saccharomyces cerevisiae |
| LYS2 | AAC02241.1 | 2853226 | Candida albicans |
| LYS5 | AAO26020.1 | 28136195 | Candida albicans |
| Lys1p | P40976.3 | 13124791 | Schizosaccharomyces pombe |
| Lys7p | Q10474.1 | 1723561 | Schizosaccharomyces pombe |
| Lys2 | CAA74300.1 | 3282044 | Penicillium chrysogenum |

1.4.1.a Oxidoreductase (Aminating).

Glutamate dehydrogenase (Step J, FIGS. 62 and 63), 4-aminobutyrate dehydrogenase (Step M, FIGS. 62 and 63), putrescine dehydrogenase (Step D, FIG. 63), 5-amino-2-oxopentanoate dehydrogenase (Step P, FIG. 63), and omithine dehydrogenase (Step S, FIG. 63) can be catalyzed by aminating oxidoreductases. Enzymes in this EC class catalyze the oxidative deamination of alpha-amino acids with NAD+ or NADP+ as acceptor, and the reactions are typically reversible. Exemplary oxidoreductases operating on amino acids include glutamate dehydrogenase (deaminating), encoded by gdhA, leucine dehydrogenase (deaminating), encoded by ldh, and aspartate dehydrogenase (deaminating), encoded by nadX. Description and exemplary enzymes can be found above in EXAMPLE IV Exemplary BDO Pathways, section on EC 1.4.1.a—Oxidoreductase operating on amino acids.

Additional glutamate dehydrogenase gene candidates are found in *Bacillus subtilis* (Khan et al., *Biosci. Biotechnol. Biochem.* 69:1861-1870 (2005)), *Nicotiana tabacum* (Pumell et al., *Planta* 222:167-180 (2005)), *Oryza sativa* (Abiko et al., *Plant Cell Physiol.* 46:1724-1734 (2005)), *Haloferax mediterranei* (Diaz et al., *Extremophiles* 10:105-115 (2006)) and *Halobactreium salinarum* (Hayden et al., *FEMS Microbiol. Lett.* 211:37-41 (2002)). The *Nicotiana tabacum* enzyme is composed of alpha and beta subunits encoded by gdh1 and gdh2 (Pumell et al., *Planta* 222:167-180 (2005)). Overexpression of the NADH-dependent glutamate dehydrogenase was found to improve ethanol production in engineered strains of *S. cerevisiae* (Roca et al *Appl. Environ. Microbiol.* 69:4732-4736 (2003)).

| Gene | Accession No. | GI No. | Organism |
|---|---|---|---|
| rocG | NP_391659.1 | 16080831 | *Bacillus subtilis* |
| gdh1 | AAR11534.1 | 38146335 | *Nicotiana tabacum* |
| gdh2 | AAR11535.1 | 38146337 | *Nicotiana tabacum* |
| GDH | Q852M0 | 75243660 | *Oryza sativa* |
| GDH | Q977U6 | 74499858 | *Haloferax mediterranei* |
| GDH | P29051 | 118549 | *Halobactreium salinarum* |
| GDH2 | NP_010066.1 | 6319986 | *Saccharomyces cerevisiae* |

An exemplary enzyme for catalyzing the conversion of aldehydes to their corresponding primary amines is lysine 6-dehydrogenase (EC 1.4.1.18), encoded by the lysDH genes. The lysine 6-dehydrogenase (deaminating), encoded by lysDH gene, catalyze the oxidative deamination of the E-amino group of L-lysine to form 2-aminoadipate-6-semialdehyde, which in turn nonenzymatically cyclizes to form Δ1-piperideine-6-carboxylate (Misono and Nagasaki, *J. Bacteriol.* 150:398-401 (1982)). The lysDH gene from *Geobacillus stearothermophilus* encodes a thermophilic NAD-dependent lysine 6-dehydrogenase (Heydari et al., *Appl. Environ. Microbiol* 70:937-942 (2004)). The lysDH gene from *Aeropyrum pernix* K1 is identified through homology from genome projects. Additional enzymes can be found in *Agrobacterium tumefaciens* (Hashimoto et al., *J. Biochem.* 106:76-80 (1989); Misono and Nagasaki, *J. Bacteriol.* 150: 398-401 (1982)) and *Achromobacter denitrficans* (Ruldeekulthamrong et al., *BMB. Rep.* 41:790-795 (2008)).

| Gene | Accession No. | GI No. | Organism |
|---|---|---|---|
| lysDH | BAB39707 | 13429872 | *Geobacillus stearothermophilus* |
| lysDH | NP_147035.1 | 14602185 | *Aeropyrum pernix* K1 |
| lysDH | NP_353966 | 15888285 | *Agrobacterium tumefaciens* |
| lysDH | AAZ94428 | 74026644 | *Achromobacter denitrificans* |

An enzyme that converts 3-oxoacids to 3-amino acids is 3,5-diaminohexanoate dehydrogenase (EC 1.4.1.11), an enzyme found in organisms that ferment lysine. The gene encoding this enzyme, kdd, was recently identified in *Fusobacterium nucleatum* (Kreimeyer et al., *J. Bio. Chem.* 282: 7191-7197 (2007)). The enzyme has been purified and characterized in other organisms (Baker et al., *J. Biol. Chem.* 247:7724-7734 (1972); Baker and van der Drift, *Biochemistry* 13:292-299 (1974)), but the genes associated with these enzymes are not known. Candidates in *Myxococcus xanthus, Porphyromonas gingivalis* W83 and other sequenced organisms can be inferred by sequence homology.

| Gene | Accession No. | GI No. | Organism |
|---|---|---|---|
| kdd | AAL93966.1 | 19713113 | *Fusobacterium nucleatum* |
| mxan_4391 | ABF87267.1 | 108462082 | *Myxococcus xanthus* |
| pg_1069 | AAQ66183.1 | 34397119 | *Porphyromonas gingivalis* |

2.3.1.a Acyltransferase (Transferring Phosphate Group to CoA).

Step P of FIG. 62 depicts the transformation of 4-hydroxybutyryl-CoA to 4-hydroxybutyryl-Pi. Exemplary phosphate transferring acyltransferases include phosphotransacetylase, encoded by pta, and phosphotransbutyrylase, encoded by ptb. Description and exemplary enzymes can be found above in EXAMPLE IV Exemplary BDO Pathways, section on EC 2.3.1.a—Acyltransferase.

2.6.1. Aminotransferase.

Aminotransferases reversibly convert an aldehyde or ketone to an amino group. Common amino donor/acceptor combinations include glutamate/alpha-ketoglutarate, alanine/pyruvate, and aspartate/oxaloacetate. Several enzymes have been shown to convert aldehydes to primary amines, and vice versa, such as 4-aminobutyrate, putrescine, and 5-amino-2-oxopentanoate. These enzymes are particularly well suited to carry out the following transformations: Step N in FIGS. 62 and 63, Steps E and Q in FIG. 63. Lysine-6-aminotransferase (EC 2.6.1.36) is one exemplary enzyme capable of forming a primary amine. This enzyme function, converting lysine to alpha-aminoadipate semialdehyde, has been demonstrated in yeast and bacteria. Candidates from *Candida utilis* (Hammer and Bode, J Basic Microbiol. 32:21-27 (1992)), *Flavobacterium lutescens* (Fujii et al., *J. Biochem.* 128:391-397 (2000)) and *Streptomyces* clavuligenus (Romero et al., *J. Ind. Microbiol. Biotechnol.* 18:241-246 (1997)) have been characterized. A recombinant lysine-6-aminotransferase from *S. clavuligenus* was functionally expressed in *E. coli* (Tobin et al., *J. Bacteriol.* 173:6223-6229 (1991)). The *F. lutescens* enzyme is specific to alpha-ketoglutarate as the amino acceptor (Soda and Misono, *Biochemistry* 7:4110-4119 (1968)). Other enzymes which convert aldehydes to terminal amines include the dat gene product in *Acinetobacter baumanii* encoding 2,4-diaminobutanoate:2-ketoglutarate 4-transaminase (Ikai and Yamamoto, *J. Bacteriol.* 179:5118-5125 (1997)). In addition to its natural substrate, 2,4-diaminobutyrate, DAT transaminates the terminal amines of lysine, 4-aminobutyrate and ornithine.

| Gene | Accession No. | GI No. | Organism |
|---|---|---|---|
| lat | BAB13756.1 | 10336502 | *Flavobacterium lutescens* |
| lat | AAA26777.1 | 153343 | *Streptomyces clavuligenus* |
| dat | P56744.1 | 6685373 | *Acinetobacter baumanii* |

The conversion of an aldehyde to a terminal amine can also be catalyzed by gamma-aminobutyrate transaminase (GABA transaminase or 4-aminobutyrate transaminase). This enzyme naturally interconverts succinic semialdehyde and glutamate to 4-aminobutyrate and alpha-ketoglutarate and is known to have a broad substrate range (Liu et al., *Biochemistry* 43:10896-10905 2004); Schulz et al., *Appl. Environ. Microbiol.* 56:1-6 (1990)). The two GABA transaminases in *E. coli* are encoded by gabT (Bartsch et al., *J. Bacteriol.* 172:7035-7042 (1990)) and puuE (Kurihara et al., *J. Biol. Chem.* 280:4602-4608. (2005)). GABA transaminases in *Mus musculus, Pseudomonas fluorescens*, and *Sus scrofa* have been shown to react with a range of alternate substrates including 6-aminocaproic acid (Cooper, *Methods Enzymol.* 113:80-82 (1985); Scott and Jakoby, *J. Biol. Chem.* 234:932-936 (1959)).

| Gene | Accession No. | GI No. | Organism |
|---|---|---|---|
| gabT | NP_417148.1 | 16130576 | *Escherichia coli* |
| puuE | NP_415818.1 | 16129263 | *Escherichia coli* |
| abat | NP_766549.2 | 37202121 | *Mus musculus* |
| gabT | YP_257332.1 | 70733692 | *Pseudomonas fluorescens* |
| abat | NP_999428.1 | 47523600 | *Sus scrofa* |

Additional enzyme candidates for interconverting aldehydes and primary amines are putrescine transminases or other diamine aminotransferases. The *E. coli* putrescine aminotransferase is encoded by the ygjG gene, and the purified enzyme also was able to transaminate cadaverine and spermidine (Samsonova et al., *BMC Microbiol.* 3:2 (2003)). In addition, activity of this enzyme on 1,7-diaminoheptane and with amino acceptors other than 2-oxoglutarate (for example, pyruvate, 2-oxobutanoate) has been reported (Kim, *J. Biol. Chem.* 239:783-786 (1964); Samsonova et al., *BMC Microbiol.* 3:2 (2003)). A putrescine aminotransferase with higher activity with pyruvate as the amino acceptor than alpha-ketoglutarate is the spuC gene of *Pseudomonas aeruginosa* (Lu et al., *J. Bacteriol.* 184:3765-3773 (2002)).

| Gene | Accession No. | GI No. | Organism |
|---|---|---|---|
| ygjG | NP_417544 | 145698310 | *Escherichia coli* |
| spuC | AAG03688 | 9946143 | *Pseudomonas aeruginosa* |

Enzymes that transaminate 3-oxoacids include GABA aminotransferase (described above), beta-alanine/alpha-ketoglutarate aminotransferase and 3-amino-2-methylpropionate aminotransferase. Beta-alanine/alpha-ketoglutarate aminotransferase (WO08027742) reacts with beta-alanine to form malonic semialdehyde, a 3-oxoacid. The gene product of SkPYD4 in *Saccharomyces kluyveri* was shown to preferentially use beta-alanine as the amino group donor (Andersen and Hansen, Gene 124:105-109 (1993)). SkUGA1 encodes a homologue of *Saccharomyces cerevisiae* GABA aminotransferase, UGA1 (Ramos et al., *Eur. J. Biochem.* 149:401-404 (1985)), whereas SkPYD4 encodes an enzyme involved in both beta-alanine and GABA transamination (Andersen and Hansen, Gene 124:105-109 (1993)). 3-Amino-2-methylpropionate transaminase catalyzes the transformation from methylmalonate semialdehyde to 3-amino-2-methylpropionate. The enzyme has been characterized in *Rattus norvegicus* and *Sus scrofa* and is encoded by Abat (Kakimoto et al., *Biochim. Biophys. Acta* 156:374-380 (1968); Tamaki et al., *Methods Enzymol.* 324:376-389 (2000)).

| Gene | Accession No. | GI No. | Organism |
|---|---|---|---|
| SkyPYD4 | ABF58893.1 | 98626772 | *Lachancea kluyveri* |
| SkUGA1 | ABF58894.1 | 98626792 | *Lachancea kluyveri* |

| Gene | Accession No. | GI No. | Organism |
|---|---|---|---|
| UGA1 | NP_011533.1 | 6321456 | *Saccharomyces cerevisiae* |
| Abat | P50554.3 | 122065191 | *Rattus norvegicus* |
| Abat | P80147.2 | 120968 | *Sus scrofa* |

Several aminotransferases transaminate the amino groups of amino acids to form 2-oxoacids. Aspartate aminotransferase is an enzyme that naturally transfers an oxo group from oxaloacetate to glutamate, forming alpha-ketoglutarate and aspartate. Aspartate is similar in structure to OHED and 2-AHD. Aspartate aminotransferase activity is catalyzed by, for example, the gene products of aspC from *Escherichia coli* (Yagi et al., *FEBS Lett.* 100:81-84 (1979); Yagi et al., *Methods Enzymol.* 113:83-89 (1985)), AAT2 from *Saccharomyces cerevisiae* (Yagi et al., *J. Biochem.* 92:35-43 (1982)) and ASP5 from *Arabidopsis thaliana* (de la Torre et al., *Plant J.* 46:414-425 (2006); Kwok and Hanson. *J. Exp. Bot.* 55:595-604 (2004); Wilkie and Warren, *Protein Expr. Purif.* 12:381-389 (1998)). The enzyme from *Rattus norvegicus* has been shown to transaminate alternate substrates such as 2-aminohexanedioic acid and 2,4-diaminobutyric acid (Recasens et al., *Biochemistry* 19:4583-4589 (1980)). Aminotransferases that work on other amino-acid substrates can also be able to catalyze this transformation. Valine aminotransferase catalyzes the conversion of valine and pyruvate to 2-ketoisovalerate and alanine. The *E. coli* gene, avtA, encodes one such enzyme (Whalen and Berg, *J. Bacteriol.* 150:739-746 (1982)). This gene product also catalyzes the transamination of α-ketobutyrate to generate α-aminobutyrate, although the amine donor in this reaction has not been identified (Whalen and Berg, *J. Bacteriol.* 158:571-574 1984)). The gene product of the *E. coli* serC catalyzes two reactions, phosphoserine aminotransferase and phosphohydroxythreonine aminotransferase (Lam and Winkler, *J. Bacteriol.* 172:6518-6528 (1990)), and activity on non-phosphorylated substrates could not be detected (Drewke et al., *FEBS Lett.* 390:179-182 (1996)).

| Gene | Accession No. | GI No. | Organism |
|---|---|---|---|
| aspC | NP_415448.1 | 16128895 | *Escherichia coli* |
| AAT2 | P23542.3 | 1703040 | *Saccharomyces cerevisiae* |
| ASP5 | P46248.2 | 20532373 | *Arabidopsis thaliana* |
| Got2 | P00507 | 112987 | *Rattus norvegicus* |
| avtA | YP_026231.1 | 49176374 | *Escherichia coli* |
| serC | NP_415427.1 | 16128874 | *Escherichia coli* |

Another enzyme candidate is alpha-aminoadipate aminotransferase (EC 2.6.1.39), an enzyme that participates in lysine biosynthesis and degradation in some organisms. This enzyme interconverts 2-aminoadipate and 2-oxoadipate, using alpha-ketoglutarate as the amino acceptor. Gene candidates are found in *Homo sapiens* (Okuno et al., *Enzyme Protein* 47:136-148 (1993)) and *Thermus thermophilus* (Miyazaki et al., *Microbiology* 150:2327-2334 (2004)). The *Thermus thermophilus* enzyme, encoded by lysN, is active with several alternate substrates including oxaloacetate, 2-oxoisocaproate, 2-oxoisovalerate, and 2-oxo-3-methylvalerate.

| Gene | Accession No. | GI No. | Organism |
|---|---|---|---|
| lysN | BAC76939.1 | 31096548 | *Thermus thermophilus* |
| AadAT-II | Q8N5Z0.2 | 46395904 | *Homo sapiens* |

2.7.2.a Phosphotransferase (Carboxy Acceptor).

Phosphotransferase enzymes in the EC class 2.7.2 transform carboxylic acids to phosphonic acids with concurrent hydrolysis of one ATP Step O of FIG. 62 involves the conversion of 4-hydroxybutyrate to 4-hydroxybutyryl-phosphate by such an enzyme. Butyrate kinase (EC 2.7.2.7) carries out the reversible conversion of butyryl-phosphate to butyrate during acidogenesis in C. acetobutylicum (Cary et al., Appl. Environ. Microbiol. 56:1576-1583 (1990)). This enzyme is encoded by either of the two buk gene products (Huang et al., J. Mol. Microbiol. Biotechnol. 2:33-38 (2000)). Other butyrate kinase enzymes are found in C. butyricum and C. tetanomorphum (Twarog and Wolfe, J. Bacteriol. 86:112-117 (1963)). Related enzyme isobutyrate kinase from Thermotoga maritima has also been expressed in E. coli and crystallized (Diao et al., Acta Crystallogr. D. Biol. Crystallogr. 59:1100-1102 (2003); Diao and Hasson, J. Bacteriol. 191:2521-2529 (2009)). Aspartokinase catalyzes the ATP-dependent phosphorylation of aspartate and participates in the synthesis of several amino acids. The aspartokinase II enzyme in E. coli, encoded by lysC, has a broad substrate range, and the catalytic residues involved in substrate specificity have been elucidated (Keng and Viola, Arch. Biochem. Biophys. 335:73-81 (1996)). Two additional kinases in E. coli are also good candidates: acetate kinase and gamma-glutamyl kinase. The E. coli acetate kinase, encoded by ackA (Skarstedt and Silverstein, J. Biol. Chem. 251:6775-6783 (1976)), phosphorylates propionate in addition to acetate (Hesslinger et al., Mol. Microbiol. 27:477-492 (1998)). The E. coli gamma-glutamyl kinase, encoded by proB (Smith et al., J. Bacteriol. 157:545-551 (1984)), phosphorylates the gamma carbonic acid group of glutamate.

| Gene | Accession No. | GI No. | Organism |
|---|---|---|---|
| buk1 | NP_349675 | 15896326 | Clostridium acetobutylicum |
| buk2 | Q97II1 | 20137415 | Clostridium acetobutylicum |
| buk2 | Q9X278.1 | 6685256 | Thermotoga maritima |
| lysC | NP_418448.1 | 16131850 | Escherichia coli |
| ackA | NP_416799.1 | 16130231 | Escherichia coli |
| proB | NP_414777.1 | 16128228 | Escherichia coli |

Acetylglutamate kinase phosphorylates acetylated glutamate during arginine biosynthesis. This enzyme is not known to accept alternate substrates; however, several residues of the E. coli enzyme involved in substrate binding and phosphorylation have been elucidated by site-directed mutagenesis (Marco-Marin et al., J. Mol. Biol. 334:459-476 (2003); Ramon-Maiques et al., Structure 10:329-342 (2002)). The enzyme is encoded by argB in Bacillus subtilis and E. coli (Parsot et al., Gene 68:275-283 (1988)), and ARG5, 6 in S. cerevisiae (Pauwels et al., Eur. J. Biochem. 270:1014-1024 (2003)). The ARG5,6 gene of S. cerevisiae encodes a polyprotein precursor that is matured in the mitochondrial matrix to become acetylglutamate kinase and acetylglutamylphosphate reductase.

| Gene | Accession No. | GI No. | Organism |
|---|---|---|---|
| argB | NP_418394.3 | 145698337 | Escherichia coli |
| argB | NP_389003.1 | 16078186 | Bacillus subtilis |
| ARG5,6 | NP_010992.1 | 6320913 | Saccharomyces cerevisiae |

2.8.3.a CoA Transferase.

The gene products of cat1, cat2, and cat3 of Clostridium kluyveri have been shown to exhibit succinyl-CoA (Step G, FIGS. 62 and 63), 4-hydroxybutyryl-CoA (Step T, FIG. 62), and butyryl-CoA acetyltransferase activity, respectively (Seedorf et al., Proc. Natl. Acad Sci. USA 105:2128-2133 (2008); Sohling and Gottschalk, J. Bacteriol 178:871-880 (1996)). Similar CoA transferase activities are also present in Trichomonas vaginalis (van Grinsven et al., J. Biol. Chem. 283:1411-1418 (2008)) and Trypanosoma brucei (Riviere et al., J. Biol. Chem. 279:45337-45346 (2004)).

| Gene | Accession No. | GI No. | Organism |
|---|---|---|---|
| cat1 | P38946.1 | 729048 | Clostridium kluyveri |
| cat2 | P38942.2 | 1705614 | Clostridium kluyveri |
| cat3 | EDK35586.1 | 146349050 | Clostridium kluyveri |
| TVAG_395550 | XP_001330176 | 123975034 | Trichomonas vaginalis G3 |
| Tb11.02.0290 | XP_828352 | 71754875 | Trypanosoma brucei |

An additionally useful enzyme for this type of transformation is acyl-CoA:acetate-CoA transferase, also known as acetate-CoA transferase (EC 2.8.3.8), which has been shown to transfer the CoA moiety to acetate from a variety of branched and linear acyl-CoA substrates, including isobutyrate (Matthies and Schink, Appl. Environ. Microbiol. 58:1435-1439 (1992)), valerate (Vanderwinkel et al., Biochem. Biophys. Res. Commun 33:902-908 (1968)) and butanoate (Vanderwinkel, supra (1968)). This enzyme is encoded by atoA (alpha subunit) and atoD (beta subunit) in E. coli sp. K12 (Korolev et al., Acta Crystallogr. D Biol. Crystallogr. 58:2116-2121 (2002); Vanderwinkel, supra (1968)). Similar enzymes exist in Corynebacterium glutamicum ATCC 13032 (Duncan et al., Appl. Environ Microbiol. 68:5186-5190 (2002)), Clostridium acetobutylicum (Cary et al., Appl. Environ. Microbiol. 56:1576-1583 (1990); Wiesenborn et al., Appl. Environ. Microbiol. 55:323-329 (1989)), and Clostridium saccharoperbutylacetonicum (Kosaka et al., Biosci. Biotechnol. Biochem. 71:58-68 (2007)).

| Gene | Accession No. | GI No. | Organism |
|---|---|---|---|
| atoA | P76459.1 | 2492994 | Escherichia coli K12 |
| atoD | P76458.1 | 2492990 | Escherichia coli K12 |
| actA | YP_226809.1 | 62391407 | Corynebacterium glutamicum |
| cg0592 | YP_224801.1 | 62389399 | Corynebacterium glutamicum |
| ctfA | NP_149326.1 | 15004866 | Clostridium acetobutylicum |
| ctfB | NP_149327.1 | 15004867 | Clostridium acetobutylicum |
| ctfA | AAP42564.1 | 31075384 | Clostridium saccharoperbutylacetonicum |
| ctfB | AAP42565.1 | 31075385 | Clostridium saccharoperbutylacetonicum |

The glutaconate-CoA-transferase (EC 2.8.3.12) enzyme from anaerobic bacterium Acidaminococcus fermentans reacts with diacid glutaconyl-CoA and 3-butenoyl-CoA (Mack and Buckel, FEBS Lett. 405:209-212 (1997)). The genes encoding this enzyme are gctA and gctB. This enzyme has reduced but detectable activity with other CoA derivatives including glutaryl-CoA, 2-hydroxyglutaryl-CoA, adipyl-CoA and acrylyl-CoA (Buckel et al., Eur. J. Biochem. 118:315-321 (1981)). The enzyme has been cloned and expressed in E. coli (Mac et al., Eur. J. Biochem. 226:41-51 (1994)).

| Gene | Accession No. | GI No. | Organism |
|---|---|---|---|
| gctA | CAA57199.1 | 559392 | Acidaminococcus fermentans |
| gctB | CAA57200.1 | 559393 | Acidaminococcus fermentans |

3.1.2.a CoA Hydrolase.

Enzymes in the 3.1.2 family hydrolyze acyl-CoA molecules to their corresponding acids. However, such enzymes can be modified to empart CoA-ligase or synthetase functionality if coupled to an energy source such as a proton pump or direct ATP hydrolysis. Several eukaryotic acetyl-CoA hydrolases (EC 3.1.2.1) have broad substrate specificity. For example, the enzyme from *Rattus norvegicus* brain (Robinson et al., *Biochem. Biophys. Res. Commun.* 71:959-965 (1976)) can react with butyryl-CoA, hexanoyl-CoA and malonyl-CoA. Though its sequence has not been reported, the enzyme from the mitochondrion of the pea leaf also has abroad substrate specificity, with demonstrated activity on acetyl-CoA, propionyl-CoA, butyryl-CoA, palmitoyl-CoA, oleoyl-CoA, succinyl-CoA, and crotonyl-CoA (Zeiher and Randall, *Plant. Physiol.* 94:20-27 (1990)). The acetyl-CoA hydrolase, ACH1, from *S. cerevisiae* represents another candidate hydrolase (Buu et al., *J. Biol. Chem.* 278:17203-17209 (2003)).

| Gene | Accession No. | GI No. | Organism |
| --- | --- | --- | --- |
| acot12 | NP_570103.1 | 18543355 | *Rattus norvegicus* |
| ACH1 | NP_009538 | 6319456 | *Saccharomyces cerevisiae* |

Another candidate hydrolase is the human dicarboxylic acid thioesterase, acot8, which exhibits activity on glutaryl-CoA, adipyl-CoA, suberyl-CoA, sebacyl-CoA, and dodecanedioyl-CoA (Westin et al., *J. Biol. Chem.* 280:38125-38132 (2005)) and the closest *E. coli* homolog, tesB, which can also hydrolyze a broad range of CoA thioesters (Naggert et al., *J. Biol. Chem.* 266:11044-11050 (1991)). A similar enzyme has also been characterized in the rat liver (Deana, *Biochem. Int.* 26:767-773 (1992)). Other potential *E. coli* thioester hydrolases include the gene products of tesA (Bonner and Bloch, *J. Biol. Chem.* 247:3123-3133 (1972)), ybgC (Kuznetsova et al., *FEMS Microbiol. Rev.* 29:263-279 (2005); Zhuang et al., *FEBS Lett.* 516:161-163 (2002)), paaI (Song et al., *J. Biol. Chem.* 281:11028-11038 (2006)), and ybdB (Leduc et al., *J. Bacteriol.* 189:7112-7126 (2007)).

| Gene | Accession No. | GI No. | Organism |
| --- | --- | --- | --- |
| acot8 | CAA15502 | 3191970 | *Homo sapiens* |
| tesB | NP_414986 | 16128437 | *Escherichia coli* |
| acot8 | NP_570112 | 51036669 | *Rattus norvegicus* |
| tesA | NP_415027 | 16128478 | *Escherichia coli* |
| ybgC | NP_415264 | 16128711 | *Escherichia coli* |
| paaI | NP_415914 | 16129357 | *Escherichia coli* |
| ybdB | NP_415129 | 16128580 | *Escherichia coli* |

Yet another candidate hydrolase is the glutaconate CoA-transferase from *Acidaminococcus fermentans*. This enzyme was transformed by site-directed mutagenesis into an acyl-CoA hydrolase with activity on glutaryl-CoA, acetyl-CoA and 3-butenoyl-CoA (Mack and Buckel, *FEBS Lett.* 405:209-212 (1997)). This indicates that the enzymes encoding succinyl-CoA:3-ketoacid-CoA transferases and acetoacetyl-CoA:acetyl-CoA transferases can also serve as candidates for this reaction step but would likely require certain mutations to change their function.

| Gene | Accession No. | GI No. | Organism |
| --- | --- | --- | --- |
| gctA | CAA57199.1 | 559392 | *Acidaminococcus fermentans* |
| gctB | CAA57200.1 | 559393 | *Acidaminococcus fermentans* |

Additional hydrolase enzymes include 3-hydroxyisobutyryl-CoA hydrolase which has been described to efficiently catalyze the conversion of 3-hydroxyisobutyryl-CoA to 3-hydroxyisobutyrate during valine degradation (Shimomura et al., *J. Biol. Chem.* 269:14248-14253 (1994)). Genes encoding this enzyme include hibch of *Rattus norvegicus* (Shimomura et al., supra (1994); Shimomura et al., *Methods Enzymol.* 324:229-240 (2000)) and *Homo sapiens* (Shimomura et al., supra (1994). Candidate genes by sequence homology include hibch of *Saccharomyces cerevisiae* and BC_2292 of *Bacillus cereus*.

| Gene | Accession No. | GI No. | Organism |
| --- | --- | --- | --- |
| hibch | Q5XIE6.2 | 146324906 | *Rattus norvegicus* |
| hibch | Q6NVY1.2 | 146324905 | *Homo sapiens* |
| hibch | P28817.2 | 2506374 | *Saccharomyces cerevisiae* |
| BC_2292 | AP09256 | 29895975 | *Bacillus cereus* |

4.1.1.a Carboxy-Lyase.

Decarboxylation of Alpha-Keto Acids. Alpha-ketoglutarate decarboxylase (Step B, FIGS. 58, 62 and 63), 5-hydroxy-2-oxopentanoic acid decarboxylase (Step Z, FIG. 62), and 5-amino-2-oxopentanoate decarboxylase (Step R, FIG. 63) all involve the decarboxylation of an alpha-ketoacid. The decarboxylation of keto-acids is catalyzed by a variety of enzymes with varied substrate specificities, including pyruvate decarboxylase (EC 4.1.1.1), benzoylformate decarboxylase (EC 4.1.1.7), alpha-ketoglutarate decarboxylase and branched-chain alpha-ketoacid decarboxylase.

Pyruvate decarboxylase (PDC), also termed keto-acid decarboxylase, is a key enzyme in alcoholic fermentation, catalyzing the decarboxylation of pyruvate to acetaldehyde. The enzyme from *Saccharomyces cerevisiae* has a broad substrate range for aliphatic 2-keto acids including 2-ketobutyrate, 2-ketovalerate, 3-hydroxypyruvate and 2-phenylpyruvate (Davie et al., *J. Biol. Chem.* 267:16601-16606 (1992)). This enzyme has been extensively studied, engineered for altered activity, and functionally expressed in *E. coli* (Killenberg-Jabs et al., *Eur. J. Biochem.* 268:1698-1704 (2001); Li and Jordan, *Biochemistry* 38:10004-10012 (1999); ter Schure et al., *Appl. Environ. Microbiol.* 64:1303-1307 (1998)). The PDC from *Zymomonas mobilus*, encoded by pdc, also has a broad substrate range and has been a subject of directed engineering studies to alter the affinity for different substrates (Siegert et al., *Protein Eng. Des. Sel.* 18:345-357 (2005)). The crystal structure of this enzyme is available (Killenberg-Jabs et al., *Eur. J. Biochem.* 268:1698-1704 (2001)). Other well-characterized PDC candidates include the enzymes from *Acetobacter pasteurians* (Chandra et al., *Arch. Microbiol.* 176:443-451 (2001)) and *Kluyveromyces lactis* (Krieger et al., *Eur. J. Biochem.* 269:3256-3263 (2002)).

| Gene | Accession No. | GI No. | Organism |
| --- | --- | --- | --- |
| pdc | P06672.1 | 118391 | *Zymomonas mobilus* |
| pdc1 | P06169 | 30923172 | *Saccharomyces cerevisiae* |
| pdc | AM21208 | 20385191 | *Acetobacter pasteurians* |
| pdc1 | Q12629 | 52788279 | *Kluyveromyces lactis* |

Like PDC, benzoylformate decarboxylase (EC 4.1.1.7) has a broad substrate range and has been the target of enzyme engineering studies. The enzyme from *Pseudomonas putida* has been extensively studied and crystal structures of this enzyme are available (Hasson et al., *Biochemistry* 37:9918-9930 (1998); Polovnikova et al., *Biochemistry* 42:1820-1830 (2003). Site-directed mutagenesis of two residues in the active site of the *Pseudomonas putida* enzyme altered the affinity (Km) of naturally and non-naturally occurring substrates (Siegert et al., *Protein Eng. Des. Sel.* 18:345-357 (2005)). The properties of this enzyme have been further modified by directed engineering (Lingen et al., *Protein Eng.* 15:585-593 (2002); Lingen et al., *Chembiochem.* 4:721-726 (2003)). The enzyme from *Pseudomonas aeruginosa*, encoded by mdlC, has also been characterized experimentally (Barrowman et al., *FEMS Microbiol. Lett.* 34:57-60 (1986)). Additional gene candidates from *Pseudomonas stutzeri*, *Pseudomonas fluorescens* and other organisms can be inferred by sequence homology or identified using a growth selection system developed in *Pseudomonas putida* (Henning et al., *Appl. Environ. Microbiol.* 72:7510-7517 (2006)).

| Gene | Accession No. | GI No. | Organism |
| --- | --- | --- | --- |
| mdlC | P20906.2 | 3915757 | *Pseudomonas putida* |
| mdlC | Q9HUR2.1 | 81539678 | *Pseudomonas aeruginosa* |
| dpgB | ABN80423.1 | 126202187 | *Pseudomonas stutzeri* |
| ilvB-1 | YP_260581.1 | 70730840 | *Pseudomonas fluorescens* |

A third enzyme capable of decarboxylating 2-oxoacids is alpha-ketoglutarate decarboxylase (KGD). The substrate range of this class of enzymes has not been studied to date. The KDC from *Mycobacterium tuberculosis* (Tian et al., *Proc. Natl. Acad Sci. USA* 102:10670-10675 (2005)) has been cloned and functionally expressed. However, it is not an ideal candidate for strain engineering because it is large (~130 kD) and GC-rich. KDC enzyme activity has been detected in several species of *rhizobia* including *Bradyrhizobium japonicum* and *Mesorhizobium loti* (Green et al., *J. Bacteriol.* 182:2838-2844 (2000). Although the KDC-encoding gene(s) have not been isolated in these organisms, the genome sequences are available, and several genes in each genome are annotated as putative KDCs. AKDC from *Euglena gracilis* has also been characterized, but the gene associated with this activity has not been identified to date (Shigeoka and Nakano, *Arch. Biochem. Biophys.* 288:22-28 (1991)). The first twenty amino acids starting from the N-terminus were sequenced (MTYKAPVKDVKFLL-DKVFKV; SEQ ID NO:45) (Shigeoka and Nakano, *Arch. Biochem. Biophys.* 288:22-28 (1991)). The gene can be identified by testing candidate genes containing this N-terminal sequence for KDC activity.

| Gene | Accession No. | GI No. | Organism |
| --- | --- | --- | --- |
| kgd | O50463.4 | 160395583 | *Mycobacterium tuberculosis* |
| kgd | NP_767092.1 | 27375563 | *Bradyrhizobium japonicum* |
| kgd | NP_105204.1 | 13473636 | *Mesorhizobium loti* |

A fourth candidate enzyme for catalyzing this reaction is branched chain alpha-ketoacid decarboxylase (BCKA). This class of enzyme has been shown to act on a variety of compounds varying in chain length from 3 to 6 carbons (Oku and Kaneda, *J. Biol. Chem.* 263:18386-18396 (1988); Smit et al., B. A., J. E. Hylckama Vlieg, W J. Engels, L. Meijer, J. T. Wouters, and G Smit. Identification, cloning, and characterization of a *Lactococcus lactis* branched-chain alpha-keto acid decarboxylase involved in flavor formation. *Appl. Environ. Microbiol.* 71:303-311 (2005)). The enzyme in *Lactococcus lactis* has been characterized on a variety of branched and linear substrates including 2-oxobutanoate, 2-oxohexanoate, 2-oxopentanoate, 3-methyl-2-oxobutanoate, 4-methyl-2-oxobutanoate and isocaproate (Smit et al., *Appl. Environ. Microbiol.* 71:303-311 (2005)). The enzyme has been structurally characterized (Berg et al., *Science* 318:1782-1786 (2007)). Sequence alignments between the *Lactococcus lactis* enzyme and the pyruvate decarboxylase of *Zymomonas mobilus* indicate that the catalytic and substrate recognition residues are nearly identical (Siegert et al., *Protein Eng. Des. Sel.* 18:345-357 (2005)), so this enzyme would be a promising candidate for directed engineering. Decarboxylation of alpha-ketoglutarate by a BCKA was detected in *Bacillus subtilis*; however, this activity was low (5%) relative to activity on other branched-chain substrates (Oku and Kaneda. Biosynthesis of branched-chain fatty acids in *Bacillus subtilis*. A decarboxylase is essential for branched-chain fatty acid synthetase. *J. Biol. Chem.* 263: 18386-18396 (1988)), and the gene encoding this enzyme has not been identified to date. Additional BCKA gene candidates can be identified by homology to the *Lactococcus lactis* protein sequence. Many of the high-scoring BLASTp hits to this enzyme are annotated as indolepyruvate decarboxylases (EC 4.1.1.74). Indolepyruvate decarboxylase (IPDA) is an enzyme that catalyzes the decarboxylation of indolepyruvate to indoleacetaldehyde in plants and plant bacteria.

| Gene | Accession No. | GI No. | Organism |
| --- | --- | --- | --- |
| kdcA | AAS49166.1 | 44921617 | *Lactococcus lactis* |

Recombinant branched chain alpha-keto acid decarboxylase enzymes derived from the E1 subunits of the mitochondrial branched-chain keto acid dehydrogenase complex from *Homo sapiens* and *Bos taurus* have been cloned and functionally expressed in *E. coli* (Davie et al., *J. Biol. Chem.* 267:16601-16606 1992); Wynn et al., *J. Biol. Chem.* 267: 1881-1887 (1992); Wynn et al., *J. Biol. Chem.* 267:12400-12403 (1992)). In these studies, the authors found that co-expression of chaperonins GroEL and GroES enhanced the specific activity of the decarboxylase by 500-fold (Wynn et al., *J. Biol. Chem.* 267:12400-12403 (1992)). These enzymes are composed of two alpha and two beta subunits.

| Gene | Accession No. | GI No. | Organism |
| --- | --- | --- | --- |
| BCKDHB | NP_898871.1 | 34101272 | *Homo sapiens* |
| BCKDHA | NP_000700.1 | 11386135 | *Homo sapiens* |

| Gene | Accession No. | GI No. | Organism |
|---|---|---|---|
| BCKDHB | P21839 | 115502434 | Bos taurus |
| BCKDHA | P11178 | 129030 | Bos taurus |

Decarboxylation of Alpha-Keto Acids. Several ornithine decarboxylase (Step U, FIG. 63) enzymes also exhibit activity on lysine and other similar compounds. Such enzymes are found in *Nicotiana glutinosa* (Lee and Cho, *Biochem. J.* 360:657-665 (2001)), *Lactobacillus* sp. 30a (Guirard and Snell, *J. Biol. Chem.* 255:5960-5964 (1980)) and *Vibrio vulnficus* (Lee et al., *J. Biol. Chem.* 282:27115-27125 (2007)). The enzymes from *Lactobacillus* sp. 30a (Momany et al., *J. Mol. Biol.* 252:643-655 (1995)) and *V. vulnificus* have been crystallized. The *V. vulnificus* enzyme efficiently catalyzes lysine decarboxylation, and the residues involved in substrate specificity have been elucidated (Lee et al., *Biol. Chem.* 282:27115-27125 (2007)). A similar enzyme has been characterized in *Trichomonas vaginalis*, but the gene encoding this enzyme is not known (Yarlett et al., *Biochem. J.* 293 (Pt 2)487-493 (1993)).

| Gene | Accession No. | GI No. | Organism |
|---|---|---|---|
| AF323910.1:1 . . . 1299 | AAG45222.1 | 12007488 | *Nicotiana glutinosa* |
| odc1 | P43099.2 | 1169251 | *Lactobacillus* sp. 30a |
| VV2_1235 | NP_763142.1 | 27367615 | *Vibrio vulnificus* |

Glutamate decarboxylase enzymes (Step L, FIGS. 62 and 63) are also well-characterized. Exemplary glutamate decarboxylases can be found in *E. coli* (De Biase et al., *Protein Expr Purif.* 8:430-438 (1996)), *S cerevisiae* (Coleman et al., *J. Biol. Chem.* 276:244-250 (2001)), and *Homo sapiens* (Bu et al., *Proc. Natl. Acad Sci. USA* 89:2115-2119 (1992); Bu and Tobin, Genomics 21:222-228 (1994)).

| Gene | Accession No. | GI No. | Organism |
|---|---|---|---|
| GAD1 | NP_000808 | 58331246 | *Homo sapiens* |
| GAD2 | NP_001127838 | 197276620 | *Homo sapiens* |
| gadA | NP_417974 | 16131389 | *Escherichia coli* |
| gadB | NP_416010 | 16129452 | *Escherichia coli* |
| GAD1 | NP_013976 | 6323905 | *Saccharomyces cerevisiae* |

Lysine decarboxylase (EC 4.1.1.18) catalyzes the decarboxylation of lysine to cadaverine. Two isozymes of this enzyme are encoded in the *E. coli* genome by genes cadA and ldcC. CadA is involved in acid resistance and is subject to positive regulation by the cadC gene product (Lemonnier and Lane, *Microbiology* 144 (Pt 3):751-760 (1998)). CadC accepts hydroxylysine and S-aminoethylcysteine as alternate substrates, and 2-Aminopimelate and 6-ACA act as competitive inhibitors to this enzyme (Sabo et al., *Biochemistry* 13:662-670 (1974)). Directed evolution or other enzyme engineering methods can be utilized to increase the activity for this enzyme to decarboxylate 2-aminopimelate. The constitutively expressed dc gene product is less active than CadA (Lemonnier and Lane, *Microbiology* 144 (Pt 3):751-760 (1998)). A lysine decarboxylase analogous to CadA was recently identified in *Vibrio parahaemolyticus* (Tanaka et al., *J. Appl. Microbiol.* 104:1283-1293 (2008)). The lysine decarboxylase from *Selenomonas ruminantium*, encoded by ldc, bears sequence similarity to eukaryotic ornithine decarboxylases, and accepts both L-lysine and L-ornithine as substrates (Takatsuka et al., *Biosci. Biotechnol. Biochem.* 63:1843-1846 (1999)). Active site residues were identified and engineered to alter the substrate specificity of the enzyme (Takatsuka et al., *J Bacteriol.* 182:6732-6741 (2000)).

| Gene | Accession No. | GI No. | Organism |
|---|---|---|---|
| cadA | AAA23536.1 | 145458 | *Escherichia coli* |
| ldcC | AAC73297.1 | 1786384 | *Escherichia coli* |
| ldc | O50657.1 | 13124043 | *Selenomonas ruminantium* |
| cadA | AB124819.1 | 44886078 | *Vibrio parahaemolyticus* |

6.2.1.a CoA synthetase.

CoA synthetase or ligase reactions are required by Step I of FIGS. 62 and 63, and Step V of FIG. 62. Succinate or 4-hydroxybutyrate are the required substrates. Exemplary genes encoding enzymes likely to carry out these transformations include the sucCD genes of *E. coli*, which naturally form a succinyl-CoA synthetase complex. This enzyme complex naturally catalyzes the formation of succinyl-CoA from succinate with the concomitant consumption of one ATP, a reaction which is reversible in vivo (Buck et al., *Biochem.* 24:6245-6252 (1985)).

| Gene | Accession No. | GI No. | Organism |
|---|---|---|---|
| sucC | NP_415256.1 | 16128703 | *Escherichia coli* |
| sucD | AAC73823.1 | 1786949 | *Escherichia coli* |

Additional exemplary CoA-ligases include the rat dicarboxylate-CoA ligase for which the sequence is yet uncharacterized (Vamecq et al., *Biochemical J.* 230:683-693 (1985)), either of the two characterized phenylacetate-CoA ligases from *P. chrysogenum* (Lamas-Maceiras et al., *Biochem. J.* 395:147-155 (2005); Wang et al., *Biochem Biophy Res Commun* 360(2):453-458 (2007)), the phenylacetate-CoA ligase from *Pseudomonas putida* (Martinez-Blanco et al., *J. Biol. Chem.* 265:7084-7090 (1990)), and the 6-carboxyhexanoate-CoA ligase from *Bacillus subtilis* (Bower et al., *J. Bacteriol.* 178(14):4122-4130 (1996)). Additional candidate enzymes are acetoacetyl-CoA synthetases from *Mus musculus* (Hasegawa et al., *Biochim. Biophys. Acta* 1779:414-419 (2008)) and *Homo sapiens* (Ohgami et al., *Biochem. Pharmacol.* 65:989-994 (2003)), which naturally catalyze the ATP-dependant conversion of acetoacetate into acetoacetyl-CoA. 4-Hydroxybutyryl-CoA synthetase activity has been demonstrated in *Metallosphaera sedula* (Berg et al., *Science* 318:1782-1786 (2007)). This function has been tentatively assigned to the Msed_1422 gene.

| Gene | Accession No. | GI No. | Organism |
|---|---|---|---|
| phl | CAJ15517.1 | 77019264 | *Penicillium chrysogenum* |
| phlB | ABS19624.1 | 152002983 | *Penicillium chrysogenum* |
| paaF | AAC24333.2 | 22711873 | *Pseudomonas putida* |
| bioW | NP_390902.2 | 50812281 | *Bacillus subtilis* |
| AACS | NP_084486.1 | 21313520 | *Mus musculus* |
| AACS | NP_076417.2 | 31982927 | *Homo sapiens* |
| Msed_1422 | YP_001191504 | 146304188 | *Metallosphaera sedula* |

ADP-forming acetyl-CoA synthetase (ACD, EC 6.2.1.13) is another candidate enzyme that couples the conversion of acyl-CoA esters to their corresponding acids with the concurrent synthesis of ATP Several enzymes with broad substrate specificities have been described in the literature. ACD I from *Archaeoglobus fulgidus*, encoded by AF 1211, was shown to operate on a variety of linear and branched-chain substrates including acetyl-CoA, propionyl-CoA, butyryl-CoA, acetate, propionate, butyrate, isobutyryate, isovalerate, succinate, fumarate, phenylacetate, indoleacetate (Musfeldt et al., *J. Bacteriol.* 184:636-644 (2002)). The enzyme from *Haloarcula marismortui* (annotated as a succinyl-CoA synthetase) accepts propionate, butyrate, and branched-chain acids (isovalerate and isobutyrate) as substrates, and was shown to operate in the forward and reverse directions (Brasen et al., *Arch. Microbiol.* 182:277-287 (2004)). The ACD encoded by PAE3250 from hyperthermophilic crenarchaeon *Pyrobaculum aerophilum* showed the broadest substrate range of all characterized ACDs, reacting with acetyl-CoA, isobutyryl-CoA (preferred substrate) and phenylacetyl-CoA (Brasen et al., supra (2004)). The enzymes from *A. fulgidus*, *H. marismortui* and *P. aerophilum* have all been cloned, functionally expressed, and characterized in *E. coli* (Musfeldt et al., supra; Brasen et al., supra (2004)).

| Gene | Accession No. | GI No. | Organism |
|---|---|---|---|
| AF1211 | NP_070039.1 | 11498810 | *Archaeoglobus fulgidus* DSM 4304 |
| scs | YP_135572.1 | 55377722 | *Haloarcula marismortui* ATCC 43049 |
| PAE3250 | NP_560604.1 | 18313937 | *Pyrobaculum aerophilum* str. IM2 |

Production of BDO Utilizing Carboxylic Acid Reductase. Described below is the generation of a microbial organism that produces 1,4-butanediol using carboxylic acid reductase enzymes. See corresponding example in WO2013/186402.

These results show that various carboxylic acid reductases can function in a BDO pathway to produce BDO.

Example XXIV

Metabolic Modifications to Improve Engineered Microorganism Characteristics

This example describes additional metabolic modifications to improve characteristics of an engineered microorganism. Such improved characteristics include, but are not limited to, increased product yield, decreased production of by-products, improved growth characteristics of the engineered microorganisms, including improved characteristics for scale up production, and the like. See corresponding example in WO2013/186402.

Cultivation Conditions for Bottles. Twenty-milliliter bottle cultivations for metabolite production or bioconversion were performed in M9 minimal salts medium (6.78 g/L $Na_2HPO_4$, 3.0 g/L $KH_2PO_4$, 0.5 g/L NaCl, 1.0 g/L $NH_4Cl$, 1 mM $MgSO_4$, 0.1 mM $CaCl_2$) supplemented with 10 mM $NaHCO_3$, 20 g/L D-glucose and 100 mM MOPS to improve the buffering capacity, 10 g/ml thiamine and the appropriate antibiotics for plasmid maintenance. *E. coli* strain MG1655 lacIQ+ was grown anaerobically, and anaerobic conditions were obtained by flushing capped anaerobic bottles with nitrogen for at least 5 min. Microaerobic conditions were used for all other strains, which were established by initially flushing capped anaerobic bottles with nitrogen for 5 min, then piercing the septum with a 23G needle (Becton-Dickenson) after inoculation. The needle was kept in the bottle during growth to allow a small amount of air to enter. Protein expression was induced with 0.2 mM IPTG when the culture reached mid-log growth phase, unless otherwise indicated in the text.

Cultivation Conditions for 96 Well-Plates. All the cultures in 96 well-plates were grown in 1.2 ml of M9 medium (composition provided above) with MOPS and appropriate antibiotics. Carbon source in the form of 5% glucose was also added. Microaerobic conditions were obtained by covering the plates with two gas-permeable adhesive seals. The edges of the seal were taped to minimize evaporation. All the cultures were grown at 37° C.

Bacterial Strains and Plasmids. Genomic DNA from bacterial strains was isolated with the PureLink Genomic DNA Mini Kit (Invitrogen) according to the manufacturer's instructions. Recombinant DNA manipulations were conducted as described (Sambrook et al., *T. Molecular Cloning: A Laboratory Manual*, Cold Spring Harbor Laboratory, Cold Spring Harbor, New York, (1989). Genes and open reading frames in the study were amplified from appropriate genomic DNA templates using the high-fidelity KOD DNA polymerase enzyme (EMD Chemicals; Billerica MA). Analytical PCR experiments for genotyping and sequencing were conducted according to standard molecular biology protocols with Taq polymerase (Promega). DNA sequencing was provided by Genewiz (South Plainfield NJ).

Procedure for Genetic Manipulations. Development of Expression Vectors for BDO Pathway. Vector backbones were obtained from Dr. Rolf Lutz of Expressys (expressys.de). The vectors and strains are based on the pZ Expression System described previously (Lutz and Bujard, *Nucleic Acids Res.* 25:1203-1210 (1997).). Vectors obtained were pZE13luc, pZA33luc, pZS*13luc and pZE22luc and contained the luciferase gene as a stuffer fragment. To replace the luciferase stuffer fragment with a lacZ-alpha fragment flanked by appropriate restriction enzyme sites, the luciferase stuffer fragment was first removed from each vector by digestion with EcoRI and XbaI. The lacZ-alpha fragment was PCR amplified from pUC19 with the following primers:

```
lacZalpha-RI
                                           (SEQ ID NO: 1)
5'GACGAATTCGCTAGCAAGAGGAGAAGTCGACATGTCCAATTCACTGG

CCGTCGTTTTAC3';

lacZalpha 3'BB
                                           (SEQ ID NO: 2)
5'-GACCCTAGGAAGCTTTCTAGAGTCGACCTATGCGGCATCAGAGCA

GA-3'.
```

This generated a fragment with a 5' end of EcoRI site, NheI site, a Ribosomal Binding Site, a SalI site and the start codon. The 3' end of the fragment contained the stop codon, XbaI, HindIII, and AvrII sites. The PCR product was digested with EcoRI and AvrII and ligated into the base vectors digested with EcoRI and XbaI (XbaI and AvrII have compatible ends and generate a non-site). Because NheI and XbaI restriction enzyme sites generate compatible ends that can be ligated together (but generate a site after ligation that is not digested by either enzyme), the genes cloned into the vectors could be "Biobricked" together (openwetware.org/wiki/Synthetic_Biology:BioBricks). Briefly, this method allows joining an unlimited number of genes into the vector using the same 2 restriction sites, as long as the sites do not appear internal to the genes, because the sites between the genes are destroyed after each addition. Initially, expression was low from these vectors, and they were subsequently modified using the Phusion® Site-Directed Mutagenesis Kit (NEB, Ipswich, MA) to insert the spacer sequence AATTAA between the EcoRI and NheI sites. This eliminated a putative stem loop structure in the RNA that bound the RBS and start codon.

All vectors have the pZ designation followed by letters and numbers indicating the origin of replication, antibiotic resistance marker and promoter/regulatory unit. The origin of replication is the second letter and is denoted by E for ColE1, A for p15A and S for pSC101 (as well as a lower copy number version of pSC101 designated S*)—based origins. The first number represents the antibiotic resistance marker (1 for Ampicillin, 2 for Kanamycin, 3 for Chloramphenicol). The final number defines the promoter that regulated the gene of interest (1 for PLtetO-1, 2 for PLlacO-1 and 3 for PAllacO-1) and each of these promoters became activated by its corresponding inducer molecule (pLtetO can be induced by tetracycline; pLlacO-1 and pAllacO-1 can be induced by IPTG). Three base vectors, pZS*13S, pZA33S and pZE13S, were then designed and constructed to serve as "inducible" plasmid vectors.

In addition to the "inducible" promoters mentioned above, a set of "constitutive" promoters were sampled from the Registry (partsregistry.org). Each of these "constitutive" promoters was then introduced into the pZS*13S vector backbone to replace the pAllacO-1 inducible promoter via Sequence and Ligation Independent Cloning (SLIC) method described by Li & Eledge (Nature Methods 2007, 4:251-256). Of these sampled "constitutive" promoters (p100, p104, p105, p107, p108, p111, p115 & p119), experiments were carried out to establish an order of promoter strength that was verified by protein expression levels. For these experiments, both "inducible" and "constitutive" plasmid vectors were employed, modified for the biobricks and SLIC insertions as discussed above. To further fine-tune protein expression levels of some overly expressed proteins, ribosomal binding site (RBS) in between promoter and gene coding sequence was modified accordingly using the RBS calculator (salis.psu.edu/software/).

The SLIC primers used for inserting a list of genes into the pZS*13S vector backbone are listed below. The lower case marks the sequences annealing to a vector backbone while the upper case marks the sequences annealing to the coding region of a gene.

1. ppc 525
Forward SLIC primer:
(SEQ ID NO: 100)
gaggagaagtcgacATGAACGAACAATATTCCGCATTGCG Reverse SLIC primer:
(SEQ ID NO: 101)
ggaagctttctagaTTAGCCGGTATTACGCATACCTGCC 2. sucAB-lpdA
Forward SLIC primer:
(SEQ ID NO: 102)
taagctagcaagaggagaagtcgacATGCAGAACAGCGCTTTGAAAG Reverse SLIC primer:
(SEQ ID NO: 103)
gcctctaggaagctttctagaTTACTTTTTCTTCGCTTTGGCG 3. galP 1120
Forward SLIC primer:
(SEQ ID NO: 104)
ctagcaagaggagaagtcgacATGCCTGACGCTAAAAAACAGGGGCGGT Reverse SLIC primer:
(SEQ ID NO: 105)
ctaggaagctttctagagtcgTTAATCGTGAGCGCCTATTTCGCGCAG 4. glk 1123
Forward SLIC primer:
(SEQ ID NO: 106)
ctagcaagaggagaagtcgacATGACAAAGTATGCATTAGTCGGTGATG
TG Reverse SLIC primer:
(SEQ ID NO: 107)
ctaggaagctttctagagtcgTTACAGAATGTGACCTAAGGTCTGGCGT
AAATG 5. glf 1786
Forward SLIC primer:
(SEQ ID NO: 108)
ctagcaagaggagaagtcgacATGAGTTCTGAAAGTAGTCAGGGTCTAG
TC Reverse SLIC primers:
(SEQ ID NO: 109)
ctaggaagctttctagagtcgTTACTTCTGGGAGCGCCACATCTC For the work discussed below, three base vectors, pZS*13S, pZA33 S and pZE13S, modified for the biobricks insertions as discussed above, were employed.

The following technique describes the construction of the incW plasmids, pPSX13 and and pPSX23R. The original incW plasmid backbone (pPSX) was obtained from Dr. John M. Pemberton (Sarovich and Pemberton, *Plasmid* 57:306-313 (2007)). The pPSX plasmid was modified to insert either an ampicillin marker (bla gene), designated as pPSX13, into a BamHI restriction enzyme site or an kanamycin marker and a R6k replication origin, designated as pPSX23R, in between BamHI and SacI restriction enzyme sites. Two similar incW plasmids were also constructed to include the ald-adh gene cassette amplified from pZS*13S-ald-adh. For pPSX13-ald-adh ampicillin-resistant plasmid, the bla-ald-adh gene cassette was inserted into a BamHI restriction enzyme site of pPSX13. To construct pPSX23R-ald-adh kanamycin resistant plasmid, the ampicillin marker (bla gene) was replaced with the "kanamycine marker-R6k replication origine" cassette in between XhoI and SacI restriction enzyme sites of pPSX23R.

The genes 033B, 1210, and 956 were inserted in the mini-F-plasmid backbone pKLJ33S as follows: PCR primers were designed to amplify the genes 033B (033BFOR and 033BREV), 1210C (1210CFOR and 1210CREV), and 956 (956FOR and 956REV) from appropriate templates. These primers included the immediate 5' (FOR) and 3' (REV) ends of each gene as denoted in upper case. Each primer also included a tail that was directly homologous to the promoter region (FOR) and terminator region (REV) of plasmid pZA33 S. A linear fragment of pZA33 S with the promoter region and terminator regions at either extreme end was amplified using Primers pZ-5' and pZ-3' and circular pZA33 S as a template. The pZA33 S linear fragment was combined with each of the 033B, 1210C, and 956 gene fragments and joined using sequence- and ligation-independent cloning to form the corresponding plasmids pZA33S-033B, pZa33S 1210C, and pZA33 S-956.

| Primer Designation | Primer Sequence | SEQ ID NO |
|---|---|---|
| 033BFOR | tagcaagaggagaagtcgacATGGACTGGAAGAAGATCTATGAAG | 110 |
| 033BREV | cctctaggaagatttctagaTTAGAATGCCGCGTTGAAG | 111 |
| 1210CFOR | tagcaagaggagaagtcgacATGAGCTGGCAAGAACTGTATC | 112 |
| 1210CREV | cctctaggaagctttctagaTTAATATTTCTCTTTAAAGCGCTTTTC | 113 |
| 956FOR | tagcaagaggagaagtcgacATGGCACGTTTTACTTTACCAAG | 114 |
| 956REV | cctctaggaagctttctagaTTACAAATTAACTTTAGTTCCATAGTATGTGC | 115 |
| 034Cmfor | accggtaaacgactcagcagcctgacgcactggcgatattattttgccttctcctcaccacagaatgttct gccacctgaCGATATCAAATTACGCCCCG | 116 |
| 034Cmrev | tgcttatccacaacattttgcgcacggttatgtggacaaaatacctggttacccaggccgtgccggcacgt taaccgggcCCTAGGTCTAGGGCGGCGGATTTG | 117 |

Primers 034Cmfor and 034Cmrev were used to amplify the 033B, 1210C, and 956 genes from the appropriate pZA33S plasmid background. These primers were designed to amplify the chloramphenicol resistance gene, pA1 promoter, particular gene of interest, and terminator elements from plasmid pZA33 S (with the sequences denoted in upper case) while tail sequences (denoted in lower case) corresponded to regions flanking but not including the ampicillin resistance gene, arabinose responsive promoter and terminator sequences of the mini-F-plasmid pKLJ12 (Jones and Keasling, Biotechnol. Bioengineer 59:659-665 (1998)).

An E. coli DP10B strain containing plasmid pKLJ12 and temperature-sensitive Red/ET helper plasmid pREDET (Tet) (GeneBridges GmbH, Heidelberg Germany) was inoculated into LB medium containing tetracycline at 10 µg/ml and ampicillin at 100 jag/ml final concentrations and incubated for 3 hours at 30° C. with shaking until cells were turbid. Arabinose to induce expression of the Red/ET recombination functions was added to a final concentration of 0.3%, the temperature was shifted to 37° C. and the cells were allowed to incubate for an additional hour with shaking. After being made electrocompetent by repeated centrifugation and resuspension in ice-cold sterile double-distilled water, these cells were mixed with 034Cmfor/034Cmrev PCR amplifications from the pZA33 S-033B, pZA33 S-1210C, or pZA33S-956 plasmids in a 1 mm cuvette and then subjected to electroporation at 1800 kV, 25 µF, 200Ω. Electroporated cells were then added to SOC growth medium, incubated at 37° C. without shaking, and then spread on LB solid medium containing chloramphenicol at 10 µg/ml final concentration and incubated at 37° C. for 18 to 24 hours. Resulting chloramphenicol-resistant single colonies were then scored for growth on solid LB media containing either tetracycline at 10 µg/ml or the ampicillin at 100 µg/ml. Colonies that were shown to be chloramphenicol resistant, tetracycline sensitive, and ampicillin sensitive were verified by PCR and DNA sequencing to contain new mini-F-plasmids that had completely exchanged the ampicillin resistance gene/arabinose responsive promoter/terminator of pKLJ12 with the chloramphenicol resistance gene/ PA1 promoter/gene-of-interest/terminator of pZA33 S by RED/ET-mediated homologous recombination, resulting in the new mini-F-plasmids pKLJ33 S-033B, pKLJ33 S-1210C, pKLJ33 S-956.

Chromosomal replacement of genes using the sacB gene. The primary method used for the insertion or deletion of genes in the chromosome of E. coli was based on the utilization of the sacB gene from Bacillus subtilis (Gay et al., J. Bacteriol. 153:1424-1431 (1983)). The vector used is pRE118 (ATCC87693) deleted of the oriT and IS sequences. The resulting vector (3.6 kb in size and carrying the kanamycin resistance gene) was sequenced and called pRE118-V2. All cloning of fragments was done into the restriction sites KpnI and PstI of pRE118-V2, unless notified. All PCR amplification used genomic DNA from E. coli MG1655 (ATCC47076) as DNA template. The first integration event in the chromosome was selected on LB agar plates containing Kanamycin (25 or 50 mg/L). Correct insertions were verified by PCR using 2 primers: one located outside the region of insertion and one in the kanamycin gene (5'-aggcagttccataggatggc-3')(SEQ ID NO: 118). Clones with the correct insertion were selected for resolution. They were sub-cultured twice in plain liquid LB at the desired temperature and serial dilutions were plated on LB-no salt-sucrose 10% plates. Clones that grew on sucrose containing plates were screened for the loss of the kanamycin resistance gene on LB-low salt agar medium and the deletion/insertion of the fragment of interest was verified by PCR and sequencing of the encompassing region.

This method was used for deleting appCB using the following primers:

| Primer Designation | Primer Sequence | SEQ ID NO |
|---|---|---|
| appCB Kpn fw | Ataataataggtaccggcggcgctggcgcagc ttgctgcg | 119 |
| appCB BamHI rv | TATTATTATGGATCCAACCCGATAATGGTAGA TCTCCCTCT | 120 |
| appCB BamHI fw | Ataataataggatccggagcagaaacaatgtg gtatttact | 121 |
| appCB Pst rv | TATTATTATCTGCAGATGCTCTTTTTTATGCA TTACAAACTGC | 122 |

As a result, the following nucleotides were deleted: 1,036,963->1,039,655 tesB and ybgC deletions were also made with aforementioned pRE-sacB-Kan vector. The primers used for making the deletion were: (5'-3')

| Primer Designation | Primer Sequence | SEQ ID NO |
|---|---|---|
| tesB-kpn-frw | taataataaggtaccaactgggcttgcttcactgg | 123 |
| tesB-bgl-rev | taataataaAGATCTGCCTCGACCGTTCAGGAAGG | 124 |
| tesB-bgl-frw | taataataaagatcttaactctccagtaacaaagctgc | 125 |
| tesB-Pst-rev | taataataaCTGCAGGCTATGTCACCACTTACGG | 126 |
| ybgC-Pst-frw | TattattattcctgcaggcgtctttgttcttccgtcC | 127 |
| ybgC-Kpn-rev | tattattatCTTCGGTACCTTTAGCATCTGCTTCGGCC | 128 |
| ybgC-Bam-rev | tattattatGGATCCCGGTAATGCAACAAAAGTTAGAGC | 129 |
| ybgC-Bam-frw | tattattatggatccaaagtgactgacatgaatatccttgatttgttc | 130 |

Nucleotides deleted as a consequence were: tesB: 473,525<-474,385; ybgC: 773,975->774,379

An ndh deletion was also made with the standard pRE-sacB-Kan vector. The primers used for making the deletion were: (5'-3')

| Primer Designation | Primer Sequence | SEQ ID NO |
|---|---|---|
| ndh-Bam-frw | taataataaggatcctacactggcggatgtggcataaac | 131 |
| ndh-Kpn-rev | taataatttggtacccATTCACAGTCACCAGGTACAACG | 132 |
| ndh-Bam-rev | taataataaGGATCCGAGAATAACATGAATGGTGCATTG | 133 |
| ndh-Pst-frw | taataatatctgcagatccacaaaaagccctggcaattg | 134 |

Nucleotides deleted as a result of the deletion were: 1,165,308->1,166,612

Deletions of yjgB, yqhD, yahK and adhP were introduced with the standard pRE-sacB-Kan vector. The primers used for making the deletion were: (5'-3')

| Primer Designation | Primer Sequence | SEQ ID NO |
|---|---|---|
| ygjB-Pst-frw | gataatcccccctgcagggagcggtaaatag | 135 |
| ygjB-Bam-rev | tattatTTTGGATCCTTCTCTGGTGTTGTTTGGG | 136 |
| yjgB-Bam-frw | tattattatggatccgcgtggtgttgaaagccg | 137 |
| yjgBKpn-rev | tattatAAAGGTACCGCCTCTTCCAGGTCAGTGAAGGG | 138 |
| yqhD-Kpn-frw | taataataaggtacccagttttggctatgccttaag | 139 |
| yqhD-Hind-rev | taataaTCATTAAGCTTGCTCCCTTTGCTGGGCC | 140 |
| yqhD-Hind-frw | taataataataagattttTacgcctcaaactttcg | 141 |
| yqhD-Pst-rev | taataataaATTGCCCTGCAGCGTAAGATTGTCGTTCAGGG | 142 |
| yahK-Kpn-frw | tattattattgtttggtacctctgtgccgct | 143 |
| yahK-Pst-rev | AATGTTCCACTCTGCAGGGATGATAATAAGGGG | 144 |
| yahK-Bam-frw | atcggatccaatcgcacactaacagactg | 145 |
| yahK-Bam-rev | ACAGCTTTGGATCCTCATTGTGTTTACTCCTGATTAGC | 146 |
| adhP XbaI fw | ataatatatctagagcagcaagccgcgcggcaggtggtcag | 147 |
| adhP PstI rv | TATTATTATCTGCAGACGCCATCCTGATCCATATGTATATGG | 148 |
| adhP Bam up rv | TATTATTATGGATCCAGTTCCTCCTTTTCGGATGATGTTCTG | 149 |
| adhP Bam down fw | ataataataggatccgaggcctttgctgcgactgccatgttc | 150 |

Nucleotides deleted as a result of each of these deletions were: ygjB: 4,493,213<-4,494,232, yqhD: 3,153,377->3,154,540, yahK: 342,108->343,157, adhP: 1,550,852<-1,551,862.

Gene Deletions Using Lambda-Red Mediated Combination: Native genes cyoABCD were deleted from the chromosome by Red-mediated recombination (ncbi.nlm.nih.gov/pubmed/10829079).

For cyoABCD deletion, the following primers were used to amplify a chloramphenicol or kanamycin resistance gene from pKD3 or pKD4 (ncbi.nlm.nih.gov/pubmed/10829079), respectively, and were flanked by FRT sites and homologies to cyoABCD:

```
LK-cyo-F1
                            (SEQ ID NO: 151)
CGCCACAACCAGTGACACCC

LK-cyo-R1
                            (SEQ ID NO: 152)
GGGGTTTTAGTCGCCCTTTCTGGC

LK-cyo-IO-down
                            (SEQ ID NO: 153)
CGGGATCTGGTGGCGTTTAAAGTG LK-cyo-IO-up
                            (SEQ ID NO: 154)
TGACGGCGTTTGTCTTCACCG
```

E. coli K-12 MG1655 carrying the Red helper plasmid pKD46 was grown in 100 ml LB medium with ampicillin and 1 mM L-arabinose at 30° C. to an OD600 of 0.3, and electroporation-competent cells were prepared as described elsewhere (Sambrook et al., *Molecular Cloning. A Laboratory Manual*, Cold Spring Harbor Laboratory, Cold Spring Harbor, NY, (1989)). A measure of 50 µl of competent cells was mixed with 400 ng of the PCR fragment in an ice-cold 0.1 cm cuvette (Bio-Rad Inc., Hercules, CA, USA). Cells were electroporated at 1.8 kV with 25 mF and 200, immediately followed by the addition of 1 ml of SOC medium (2% Bacto Tryptone (Difco), 0.5% yeast extract (Difco), 10 mM NaCl, 2.5 mM KCl, 10 mM MgCl$_2$, 10 mM MgSO$_4$, 20 mM glucose) with 1 mM L-arabinose. After incubation for 2 h at 37° C., one-tenth portion was spread onto agar plate to select chloramphenicolR or kanamycinR transformants at 37° C. The individual deletions were then transduced into new host strains using P1vir and selecting for the appropriate antibiotic (Silhavy et al., *Experiments with gene fusions*, Cold Spring Harbor Laboratory, Cold Spring Harbor, NY (1984)). The chloramphenicol or kanamycin resistant colonies were then transformed with the temperature sensitive plasmid pCP20, and plated on ampicillin (100 µg/ml) plates at 30° C. pCP20 contains the yeast Flp recombinase gene, chloramphenicol and ampicillin resistant genes, and temperature sensitive replication. Colonies were grown in LB medium without antibiotics at 42° C. overnight and streak plated on prewarmed LB Agar plates and grown at 42° C. Individual clones were tested for sensitivity to ampicillin and chloramphenicol or kanamycin to isolate clones which had lost the pCP20 plasmid and had the chloramphenicol or kanamycin resistance gene lost via the Flp recombinase. Positive clones with deletions in cyoABCD contain a single FRT "scar" and were verified by PCR using primers which flanked their respective genes.

The nucleotides deleted because of the cyoABCD deletion were: 449,887->447,270

The esterase from *Yersinia intermedia* was integrated in the chromosome with the standard pRed technique described above. The primers used for making the insertion were: (5'-3')

| Primer Designation | Primer Sequence | SEQ ID NO |
|---|---|---|
| JE310 | ACGCTATGGAACTGCAGGATGAGAGCATGAAATGGAACGGATGCGCGCCTTAT | 155 |
| JE311 | ACGCTATGGAACTGCAGGATGAGAGCATCTGCCCCAGATCGTTGGCTTTTTGC | 156 |
| JE312 | TTTGAAAACAGGATGTAGCGATGACCGATATTCGCTTGTA | 157 |
| JE312-rv | TACAAGCGAATATCGGTCATCGCTACATCCTGTTTTCAAA | 158 |
| JE313 | CGCCTGAATACTACGATTGACTGGAGAATGCGAATGAACA | 159 |
| JE313-rv | TGTTCATTCGCATTCTCCAGTCAATCGTAGTATTCAGGCG | 160 |
| JE314 | TTTGAAAACAGGATGTAGCGGCCCGTAGTCTGCAAATCC | 161 |
| JE314-rv | GGATTTGCAGACTACGGGCCGCTACATCCTGTTTTCAAA | 162 |
| JE315 | GCATTACGCTGACTTGACGGCTGGAGAATGCGAATGAACA | 163 |
| JE315-rv | TGTTCATTCGCATTCTCCAGCCGTCAAGTCAGCGTAATGC | 164 |

The sequence that was inserted at the gabD locus (ORF swap) was:

```
                            (SEQ ID NO: 165)
ACTGGAGAATGCGAATGAACAGCAATAAAGAGTTAATGCAGCGCCGCAG

TCAGGCGATTCCCCGTGGCGTTGGGCAAATTCACCCGATTTTCGCTGAC

CGCGCGGAAAACTGCCGGGTGTGGGACGTTGAAGGCCGTGAGTATCTT

GATTTCGCGGGCGGGATTGCGGTGCTCAATACCGGGCACCTGCATCCG

AAGGTG.
```

Figure 67:
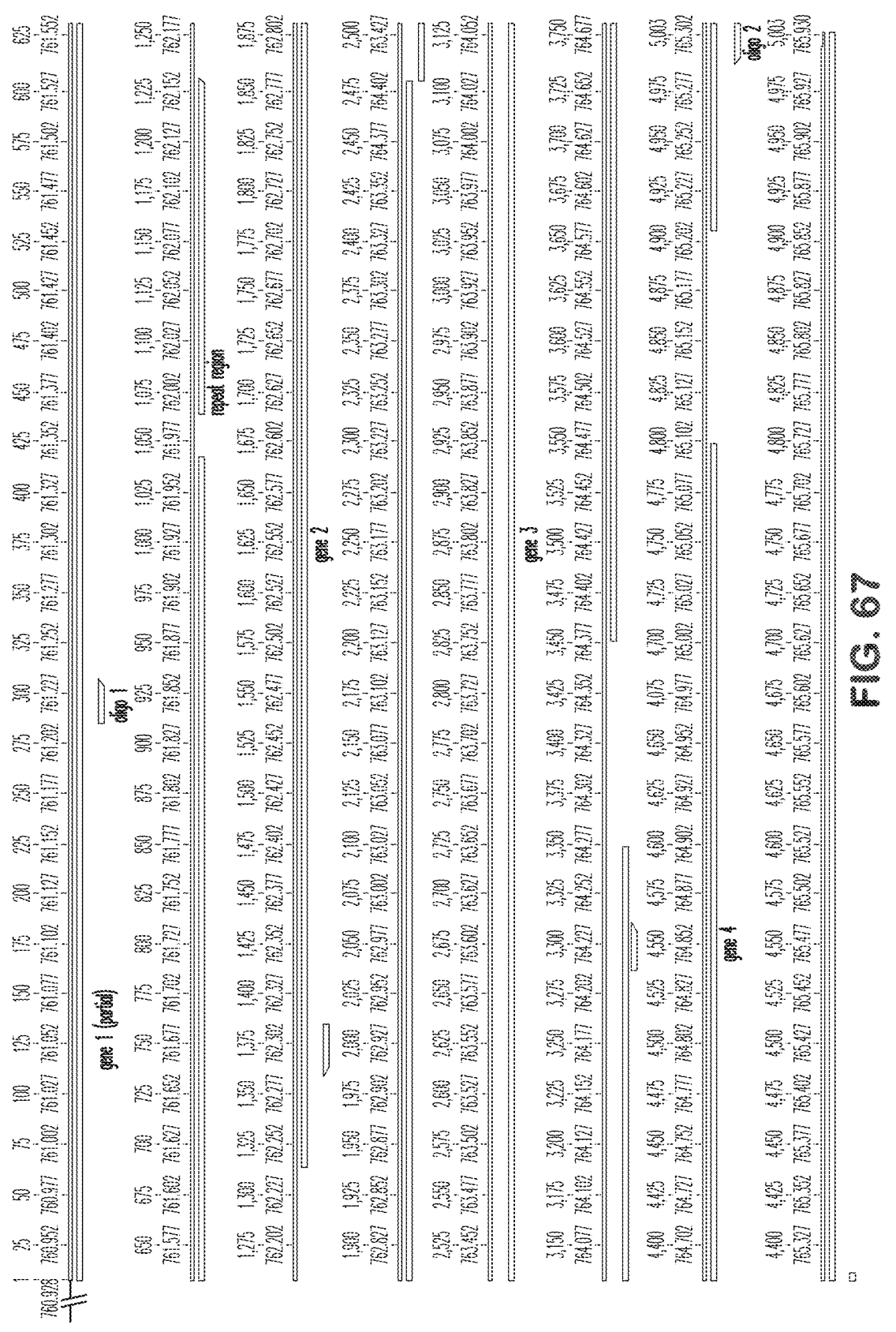

Markerless Deletion of sucC and sucD. Deletion of the native *Escherichia coli* sucC (gene 2) and sucD (gene 3) from the chromosome (FIG. 67) was achieved using a two-step double-crossover homologous recombination method. Recombination was catalyzed via expression of the Lambda phage Red genes from pRED-Amp (Gene Bridges, Heidelberg Germany). Genes encoding levansucrase (gene 6) and kanamycin resistance (gene 7) were integrated into the chromosome, replacing the majority of sucC (gene 2) and sucD (gene 3). Kanamycin was used to select for successful integrants. In a second double-crossover homologous recombination step, the integrated sequence containing the levansucrase gene (gene 6) and kanamycin resistance gene (gene 7) was replaced with an appropriate DNA sequence lacking the majority of sucC (gene 2) and sucD (gene 3), and sucrose resistant clones were selected for.

Linear double-stranded DNA sequences used in the two homologous recombination steps outlined above were constructed via standard molecular biological techniques. To make the sequence used in the initial integration step, a 1100 bp sequence from within sucB (gene 1) through the 69th base pair of sucC (gene 2) was amplified by PCR from *Escherichia coli* MG1655 genomic DNA using oligonucleotide 1 and oligonucleotide 3 (FIG. 68*a*). The genes encoding levansucrase (gene 6) and kanamycin resistance (gene 7) were amplified by PCR from plasmid pRE-118 DNA using oligonucleotide 5 and oligonucleotide 6 (FIG. 68*b*). Another 1100 bp sequence from the 811th bp of sucD (gene 3), spanning mngR (gene 4) and part of mngA (gene 5) was amplified by PCR from *Escherichia coli* MG1655 genomic DNA using oligonucleotide 4 and oligonucleotide 2 (FIG. 68*a*). 20 bp of oligonucleotide 3 overlaps with oligonucleotide 5 and 20 bp of oligonucleotide 6 overlaps with oligonucleotide 4, such that the three overlapping PCR products can be combined and amplified using standard procedures (FIG. 68*c*). Likewise, the linear double-stranded DNA sequences used in the second recombination for deletion of sucCD was made by combining and amplifying two overlapping PCR products. A 1100 bp sequence from within sucB (gene 1) through the 69th base pair of sucC (gene 2) was amplified by PCR from *Escherichia coli* MG1655 genomic DNA using oligonucleotide 1 and oligonucleotide 8 (FIG. 68*d*). Another 1100 bp sequence from the 811th bp of sucD (gene 3), spanning mngR (gene 4) and part of mngA (gene 5) was amplified by PCR from *Escherichia coli* MG1655 genomic DNA using oligonucleotide 7 and oligonucleotide 2 (FIG. 68*d*). Oligonucleotide 7 overlaps with oligonucleotide 8, such that the two overlapping PCR products can be combined and amplified using standard procedures (FIG. 68*e*). The nucleotides deleted because of the sucCD deletion are from: 762,306->764,320.

| Oligo-nucleotide | | SEQ ID NO |
|---|---|---|
| 1 | GGCGAAAGAGTCTGCTCCGGC | 166 |
| 2 | CATTCAGACACAACGCATCGCGG | 167 |
| 3 | GGCTTACCAGCACCGGTGGGTTATGCCCGTAGTCTGACAATCC | 168 |
| 4 | GCATTACGCTGACTTGACGGGTGAAAACCGTTCGCAGCCTGG | 169 |
| 5 | GGCTTACCAGCACCGGTGGGTTATGCCCGTAGTCTGCAAATCC | 170 |
| 6 | CCAGGCTGCGAACGGTTTTCACCCGTCAAGTCAGCGTAATGC | 171 |
| 7 | GGCTTACCAGCACCGGTGGGTTATGTGAAAACCGTTCGCAGCCTGG | 172 |
| 8 | CCAGGCTGCGAACGGTTTTCACATAACCCACCGGTGCTGGTAAGCC | 173 |

Analytical Procedures: HPLC, LCMS/MS and GCMS were employed for analysis of cell culture and fermentation samples. Good correlation between the two techniques (variation within 10%) provided method cross-validation and ensured data accuracy.

Organic acids, acetate, pyruvate, lactate and succinate, as well as BDO, were measured by HPLC (Agilent 1100) equipped with diode array and refractive index (RI) detectors, using an ion exclusion Carbomix H-NP5 column (Sepax) with 5 mM sulfuric acid as the mobile phase at 0.6 mL/min flow rate, and 55° C. column temperature. Organic acids were monitored in both UV absorption at 210 nm and refractive index detector, while BDO, ethanol and simple sugars were measured using RI only. All chemicals and reagents were from Sigma-Aldrich (St. Louis, MO, USA).

LCMS/MS analysis was performed on API3200 triple quadrupole system (AB Sciex, Life Technologies, Carlsbad, CA), interfaced with Agilent 1200 HPLC, utilizing electrospray ionization and MRM based acquisition methods. BDO, 4HB, GBL, Glu, Ala and GABA and internal standards ($^{13}C$ isotopically labeled analogs were used for each analyte, respectively, to compensate for the matrix effects and ensure linearity) were monitored in positive ionization mode. Negative ionization was used, when desired, for quantitation of acidic analytes, for example, pyruvate, lactate, succinate and 4HB. Chromatographic separation was conducted on Zorbax Eclipse XDB C18 4.6×30 mm, 1.8 µm particle size, maintaining column at 45° C., flow rate 0.7 mL/min. Injection volume was 5 uL. Eluents consisted of water with 0.1% formic acid and methanol with 0.1% formic acid, analytes of interest eluted under isocratic conditions of 5% methanol followed by the step gradient to 95% methanol, resulting in 2 min long LCMS method. Filtered samples were diluted in water, containing internal standards, dilution factor varied from 200 to 10,000 depending on concentrations of metabolites of interest. Dilution in water of 100-fold of greater resulted in no ion suppression effects observed for media composition and conditions used in 1,4-Butanediol production in *E. coli* (Yim et al., *Nature Chemical Biology* 7, 445-452, (2011)). Quantitation dynamic ranges were from 0.05-200 uM for BDO and other analytes. Quantitation was performed using Analyst software. LCMS/MS approach was a preferred method for monitoring BDO, 4HB, GBL, Glu, Ala and GABA due to its fast tunaround time allowing high throughput operation.

In GCMS approach, BDO, 4HB, lactate and succinate in culture broth samples were derivatized by trimethylsilylation and quantitatively analyzed by GCMS, using a procedure adapted from the literature with some modifications. The developed method demonstrated sensitivity down to low µM level, linearity in 0.05-15 mM range, as well as good reproducibility. 100 µL filtered samples were dried down in a speedvac concentrator for approximately 1 hour at ambient temperature, followed by the addition of 20 µL 10 mM cyclohexanol solution, as an internal standard, in dimethylformamide. 100 µL N,O-bis(trimethylsilyl)triflouro-acetimide (BSTFA) with 1% trimethylchlorosilane was added, and the mixture was incubated at 70° C. for 30 min. The derivatized samples were centrifuged for 5 min and directly injected into GCMS (Agilent 6890N/5973N). An Rtx-5SIL MS capillary column (Restek, 30 m×0.25 mm ID×0.25 m film thickness) was used. The GC was operated in a split injection mode introducing 1 μL of sample at 20:1 split ratio. The injection port temperature was 250° C. Helium was used as a carrier gas, and the flow rate was maintained at 1.0 mL/min. A temperature gradient program was optimized to ensure good resolution of the analytes of interest and minimum matrix interference. The oven was initially held at 80° C. for 1.5 min, then ramped to 140° C. at 10° C./min and 3 min hold, followed by fast ramping to 300° C. at 100° C./min and final hold for 5 min. The MS interface transfer line was maintained at 280° C. The total analysis time was 17 min including 4 min solvent delay. Standard calibration curves were constructed using analyte solutions in the corresponding cell culture or fermentation medium to match sample matrix as close as possible. Ethanol was assayed by GCMS as well, following sample dilution in methanol, using an HP-InnoWax capillary column (30 m, 0.25 mm ID, 0.25 um film thickness). GCMS data were processed using ChemStation software (Agilent).

Residual glucose in the fermentation samples was measured using either a YSI instrument or HPLC-UV-RI. Ethanol was measured by either YSI or GCMS.

Figure 69:
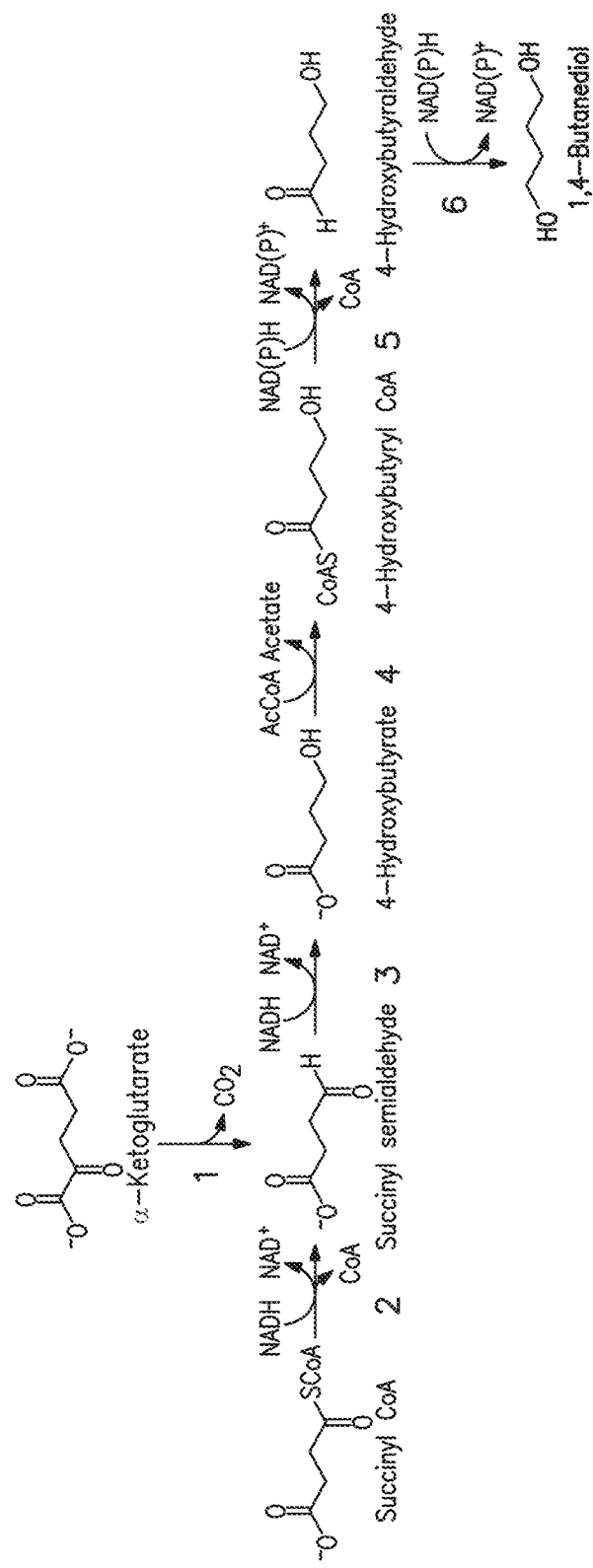
FIG. 69 shows an exemplary BDO pathway. Enzyme names for each numbered step are as follows: (1) alpha-ketoglutarate decarboxylase; (2) CoA-dependent succinate semialdehyde dehydrogenase; (3) 4-hydroxybutyrate dehydrogenase; (4) 4-hydroxybutyryl-CoA transferase; (5) 4-hydroxybutyryl-CoA reductase; (6) 4-hydroxybutyraldehyde reductase.

The metabolic engineering strategies described herein were applied to increase 1,4-butanediol production in *Escherichia coli* or otherwise improve characteristics of the engineered microorganisms. The employed 1,4-butanediol pathway for these studies is depicted in FIG. 69. The genes tested for each of the six steps shown in FIG. 69 are described in Tables 22, 26, 28, 30, 34 and 37.

Example XXV

Production of 4-Hydroxybutyrate and 1,4-Butanediol Upon Expression of Genes Encoding Alpha-Ketoglutarate Decarboxylase Enzymes This example describes production of 4-hydroxybutyrate (4HB or 4hb) and 1,4-butanediol (BDO) in cells engineered to express genes encoding alpha-ketoglutarate decarboxylase enzymes. See corresponding example in WO2013/186402.

Several heterologous alpha-ketoglutarate decarboxylase genes (Table 22) were expressed in *E. coli* from the pZS*-13S plasmid to allow a functional pathway from alpha-ketoglutarate to 4-hydroxybutyrate and 1,4-butanediol. Host strains include 3125, 2869, and 3812. These host strains are based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). For this study, the *M. bovis* sucA and *P. gingivalis* sucD genes were deleted in strains 3125, 2869, and 3812. Additionally, strains 3125, 2869, and 3812 each contain a chromosomally integrated copy of 4-hydroxybutyryl-CoA transferase expressed from the pA promoter at the attB locus. Strains 2869 and 3812 were tested with 4-hydroxybutyryl-CoA reductase and 4-hydroxybutyraldehyde reductase expressed from the pPSX23R plasmid. Tables 23, 24, and 25 show that expression of heterologous alpha-ketoglutarate decarboxylase genes enhances 4hb and/or BDO production in strains 3125, 2869, and 3812, respectively, over the controls denoted by "pZS*13S". Cells were cultured using the 96 well-plate protocol described previously.

TABLE 22

Genes encoding functional alpha-ketoglutarate decarboxylase enzymes.

| Gene Number | Organism | Accession | GI |
|---|---|---|---|
| 42 | *Mycobacterium tuberculosis* | ZP_06504371.1 | 289744993 |
| 1717 | *Mycobacterium smegmatis* | YP_889299.1 | 118472055 |
| 1720 | *Saccharopolyspora erythraea* | YP_001108480.1 | 134102819 |
| 1727 | *Jonesia denitrificans* | YP_003161752.1 | 256833025 |
| 1715 | *Mycobacterium avium* subsp. *Paratuberculosis* | NP_961470.1 | 41408634 |
| 1718 | *Nocardia farcinica* | YP_120910.2 | 161598437 |
| 1726 | *Streptomyces avermitilis* | NP_824148.1 | 29829514 |
| 1727 | *Jonesia denitrificans* | YP_003161752.1 | 256833025 |
| 1913 | *Zymomonas mobilis* | YP_162422.1 | 56551583 |
| 1914 | *Pseudomonas putida* | NP_743318.1 | 26987893 |
| 1915 | *Mycobacterium avium* subsp. *Paratuberculosis* | EGO39007.1 | 336460099 |
| 1916 | *Streptomyces griseus* | YP_001827718.1 | 182439999 |
| 1917 | *Methanosarcina acetivorans* | NP_616881.1 | 20090806 |
| 1918 | *Clostridium ljungdahlii* | YP_003782019.1 | 300857035 |
| 1920 | *Synechocystis* sp. PCC 6803 | NP_441304.1 | 16330576 |
| 1921 | *Synechococcus* sp. PCC 7335 | ZP_05039761.1 | 254426044 |
| 1922 | *Clostridium acetobutylicum* | NP_350234.1 | 15896885 |
| 1923 | *Clostridium carboxidivorans* P7 | ZP_05391417.1 | 255524461 |

TABLE 23

BDO and 4-hydroxybutyrate (4HB) production of *E. coli* host strain 3125 containing several alternative alpha-ketoglutarate decarboxylase plasmid constructs. The plasmid construct denoted by only "pZS*13S" contains no alpha-ketoglutarate decarboxylase gene. Plasmid constructs denoted by pZS*13S followed by a number express the alpha-ketoglutarate decarboxylase gene denoted by such number. BDO and 4HB concentrations are in mM.

| Host strain | Plasmid | OD 19 h | LCMS- 19 h 4HB | LCMS- 19 h BDO |
|---|---|---|---|---|
| 3125 | pZS*13S | 3.61 | 0.208 | 0.327 |
| 3125 | pZS*13S | 2.01 | 0.259 | 0.082 |
| 3125 | pZS*13S | 3.39 | 0.208 | 0.359 |
| 3125 | pZS*13S | 3.38 | 0.178 | 0.352 |
| 3125 | pZS*13S | 3.84 | 0.277 | 0.478 |
| 3125 | pZS*13S | 4.01 | 0.253 | 0.479 |
| 3125 | pZS*13S | 3.88 | 0.283 | 0.422 |
| 3125 | pZS*13S | 3.54 | 0.192 | 0.499 |
| 3125 | pZS*13S-1717 | 4.30 | 17.300 | 1.520 |
| 3125 | pZS*13S-1717 | 3.52 | 17.400 | 1.280 |
| 3125 | pZS*13S-1717 | 3.79 | 17.700 | 1.540 |
| 3125 | pZS*13S-1717 | 3.53 | 17.800 | 1.550 |
| 3125 | pZS*13S-1720 | 2.92 | 3.940 | 0.196 |
| 3125 | pZS*13S-1720 | 1.58 | 2.140 | 0.037 |
| 3125 | pZS*13S-1720 | 1.97 | 2.600 | 0.072 |
| 3125 | pZS*13S-1720 | 3.11 | 3.870 | 0.261 |
| 3125 | pZS*13S-1727 | 12.05 | 2.330 | 0.694 |
| 3125 | pZS*13S-1727 | 3.23 | 3.040 | 1.320 |
| 3125 | pZS*13S-1727 | 3.19 | 3.490 | 1.560 |
| 3125 | pZS*13S-1727 | 4.86 | 2.500 | 0.657 |
| 3125 | pZS*13S-1715 | 3.89 | 14.900 | 1.880 |
| 3125 | pZS*13S-1715 | 4.14 | 15.600 | 1.950 |
| 3125 | pZS*13S-1715 | 4.07 | 15.700 | 1.910 |
| 3125 | pZS*13S-1715 | 3.03 | 14.300 | 1.600 |
| 3125 | pZS*13S-1718 | 2.36 | 4.020 | 0.277 |
| 3125 | pZS*13S-1718 | 1.82 | 4.630 | 0.406 |

TABLE 23-continued

BDO and 4-hydroxybutyrate (4HB) production of E. coli host strain 3125 containing several alternative alpha-ketoglutarate decarboxylase plasmid constructs. The plasmid construct denoted by only "pZS*13S" contains no alpha-ketoglutarate decarboxylase gene. Plasmid constructs denoted by pZS*13S followed by a number express the alpha-ketoglutarate decarboxylase gene denoted by such number. BDO and 4HB concentrations are in mM.

| Host strain | Plasmid | OD 19 h | LCMS- 19 h 4HB | LCMS- 19 h BDO |
|---|---|---|---|---|
| 3125 | pZS*13S-1718 | 2.37 | 3.690 | 0.265 |
| 3125 | pZS*13S-1718 | 2.26 | 3.940 | 0.273 |
| 3125 | pZS*13S-1718 | 2.04 | 4.890 | 0.389 |
| 3125 | pZS*13S-1718 | 2.42 | 4.720 | 0.338 |
| 3125 | pZS*13S-1718 | 2.16 | 4.530 | 0.377 |
| 3125 | pZS*13S-1718 | 2.43 | 5.190 | 0.517 |

TABLE 24

BDO and 4-hydroxybutyrate (4HB) production of E. coli host strain 2869 containing several alternative alpha-ketoglutarate decarboxylase plasmid constructs. The plasmid construct denoted by only "pZS*13S" contains no alpha-ketoglutarate decarboxylase gene. Plasmid constructs denoted by pZS*13S followed by a number express the alpha-ketoglutarate decarboxylase gene denoted by such number. BDO and 4HB concentrations are in mM.

| Host strain | Plasmid | OD 16 h | LCMS- 16 h 4HB | LCMS- 16 h BDO |
|---|---|---|---|---|
| 2869 | pZS*13S | 3.39 | 0.04 | 0.42 |
| 2869 | pZS*13S | 3.41 | 0.04 | 0.42 |
| 2869 | pZS*13S | 3.43 | 0.04 | 0.35 |
| 2869 | pZS*13S | 3.51 | 0.04 | 0.39 |
| 2869 | pZS*13S | 3.51 | 0.03 | 0.39 |
| 2869 | pZS*13S | 3.50 | 0.04 | 0.40 |
| 2869 | pZS*13S | 3.55 | 0.03 | 0.36 |
| 2869 | pZS*13S | 3.50 | 0.02 | 0.35 |
| 2869 | pZS*13S-042 | 3.50 | 0.33 | 2.81 |
| 2869 | pZS*13S-042 | 3.52 | 0.32 | 2.69 |
| 2869 | pZS*13S-042 | 3.58 | 0.32 | 3.05 |
| 2869 | pZS*13S-042 | 3.49 | 0.28 | 2.61 |
| 2869 | pZS*13S-042 | 3.39 | 0.30 | 2.87 |
| 2869 | pZS*13S-042 | 3.41 | 0.28 | 3.06 |
| 2869 | pZS*13S-042 | 3.44 | 0.27 | 2.64 |
| 2869 | pZS*13S-042 | 3.28 | 0.33 | 2.90 |
| 2869 | pZS*13S-1726 | 2.74 | 0.34 | 2.27 |
| 2869 | pZS*13S-1726 | 2.78 | 0.23 | 2.75 |
| 2869 | pZS*13S-1726 | 2.96 | 0.43 | 2.80 |
| 2869 | pZS*13S-1726 | 2.84 | 0.34 | 2.33 |
| 2869 | pZS*13S-1727 | 3.43 | 0.06 | 2.39 |
| 2869 | pZS*13S-1727 | 2.79 | 0.07 | 2.18 |
| 2869 | pZS*13S-1727 | 3.09 | 0.07 | 2.12 |
| 2869 | pZS*13S-1727 | 3.03 | 0.07 | 2.38 |

TABLE 25

BDO and 4-hydroxybutyrate (4HB) production of E. coli host strain 3812 containing several alternative alpha-ketoglutarate decarboxylase plasmid constructs. The plasmid construct denoted by only "pZS*13S" contains no alpha-ketoglutarate decarboxylase gene. Plasmid constructs denoted by pZS*13S followed by a number express the alpha-ketoglutarate decarboxylase gene denoted by such number. BDO and 4HB concentrations are in mM.

| Host strain | Plasmid | OD 24 h | LCMS- 24 h 4HB | LCMS- 24 h BDO |
|---|---|---|---|---|
| 3812 | pZS*13S | 3.75 | 0.07 | 1.71 |
| 3812 | pZS*13S | 3.74 | 0.05 | 1.46 |
| 3812 | pZS*13S | 3.49 | 0.04 | 2.08 |
| 3812 | pZS*13S | 3.59 | 0.05 | 2.31 |
| 3812 | pZS*13S-1913 | 3.40 | 6.51 | 9.25 |
| 3812 | pZS*13S-1913 | 3.28 | 6.46 | 8.69 |
| 3812 | pZS*13S-1913 | 3.41 | 6.22 | 8.53 |
| 3812 | pZS*13S-1913 | 3.25 | 5.94 | 7.89 |
| 3812 | pZS*13S-1914 | 3.83 | 23.10 | 85.00 |
| 3812 | pZS*13S-1914 | 3.41 | 29.70 | 93.10 |
| 3812 | pZS*13S-1914 | 3.68 | 19.90 | 63.10 |
| 3812 | pZS*13S-1914 | 3.45 | 27.20 | 101.00 |
| 3812 | pZS*13S-1915 | 4.17 | 0.30 | 3.28 |
| 3812 | pZS*13S-1915 | 3.78 | 0.18 | 3.11 |
| 3812 | pZS*13S-1915 | 3.95 | 0.14 | 3.08 |
| 3812 | pZS*13S-1915 | 3.97 | 0.11 | 2.80 |
| 3812 | pZS*13S-1916 | 4.09 | 0.07 | 4.82 |
| 3812 | pZS*13S-1916 | 3.69 | 0.12 | 4.54 |
| 3812 | pZS*13S-1916 | 3.86 | 0.09 | 4.73 |
| 3812 | pZS*13S-1916 | 3.82 | 0.08 | 4.89 |
| 3812 | pZS*13S-1917 | 3.61 | 0.08 | 2.70 |
| 3812 | pZS*13S-1917 | 3.99 | 0.06 | 2.92 |
| 3812 | pZS*13S-1917 | 3.59 | 0.12 | 2.74 |
| 3812 | pZS*13S-1917 | 3.57 | 0.11 | 2.64 |
| 3812 | pZS*13S-1918 | 3.10 | 0.25 | 6.43 |
| 3812 | pZS*13S-1918 | 2.93 | 0.34 | 5.94 |
| 3812 | pZS*13S-1918 | 2.98 | 0.23 | 6.48 |
| 3812 | pZS*13S-1918 | 3.03 | 0.23 | 6.53 |
| 3812 | pZS*13S-1920 | 3.30 | 11.20 | 44.10 |
| 3812 | pZS*13S-1920 | 3.57 | 16.60 | 64.20 |
| 3812 | pZS*13S-1920 | 3.71 | 15.00 | 59.10 |
| 3812 | pZS*13S-1920 | 3.55 | 16.30 | 62.40 |
| 3812 | pZS*13S-1921 | 3.99 | 0.23 | 9.07 |
| 3812 | pZS*13S-1921 | 3.70 | 0.24 | 8.76 |
| 3812 | pZS*13S-1921 | 4.01 | 0.24 | 9.79 |
| 3812 | pZS*13S-1921 | 3.88 | 0.27 | 9.35 |
| 3812 | pZS*13S-1922 | 2.46 | 0.06 | 4.00 |
| 3812 | pZS*13S-1922 | 2.79 | 0.23 | 5.55 |
| 3812 | pZS*13S-1922 | 2.61 | 0.23 | 5.25 |
| 3812 | pZS*13S-1922 | 2.93 | 0.18 | 5.53 |
| 3812 | pZS*13S-1923 | 2.82 | 0.25 | 6.46 |
| 3812 | pZS*13S-1923 | 2.48 | 0.22 | 6.43 |
| 3812 | pZS*13S-1923 | 2.69 | 0.17 | 4.42 |
| 3812 | pZS*13S-1923 | 3.18 | 0.18 | 10.50 |

Example XXVI

Production of 4HB and BDO Upon Expression of Genes Encoding CoA-dependant Succinate Semialdehyde Dehydrogenase Enzymes This example describes production of 4HB and BDO upon expression of genes encoding CoA-dependant succinate semialdehyde dehydrogenase enzymes. See corresponding example in WO2013/186402.

Several heterologous CoA-dependant succinate semialdehyde dehydrogenase genes (Table 26) were expressed in E. coli from the pZS*-13S plasmid to allow a functional pathway from succinyl-CoA to 4-hydroxybutyrate and 1,4-butanediol. Host strain 3744 is based on strain ECKh-432 whose construction is described above and in US20110045575. Notable modifications include deletions in adhE, ldhA, pflB, mdh, and arcA. Strain ECKh-432 also contains chromosomally integrated copies of sucD from Porphyromonas gingivalis (encoding CoA-dependant succinate semialdehyde dehydrogenase), sucA from Mycobacterium bovis (encoding alpha-ketoglutarate decarboxylase), 4hbd from P. gingivalis (encoding 4-hydroxybutyrate dehydrogenase), and 4hbd from Clostridium kluyveri (encoding 4-hydroxybutyrate dehydrogenase). For this study, the *M. bovis* sucA and *P. gingivalis* sucD genes were deleted in strain 3744. Additionally, strain 3744 contains a chromosomally integrated copy of 4-hydroxybutyryl-CoA transferase expressed from the pA promoter at the attB locus. It also contains a pPSX23R plasmid expressing 4-hydroxybutyryl-CoA reductase and 4-hydroxybutyraldehyde reductase. Table 27 shows that expression of heterologous CoA-dependant succinate semialdehyde dehydrogenase genes enhances 4hb and/or BDO production in strain 3744 over the controls denoted by "pZS*13S". Cells were cultured using the 96 well-plate protocol described previously.

TABLE 26

Genes Encoding Functional CoA-dependant Succinate Semialdehyde Dehydrogenase Enzymes

| Gene Number | Organism | Accession | GI |
|---|---|---|---|
| 35 | *Porphyromonas gingivalis* W83 | NP_904963.1 | 34540484 |
| 49 | *Clostridium difficile* 630 | YP_001088857.1 | 126699960 |
| 1870 | *Metallosphaera sedula* | YP_001190808.1 | 146303492 |
| 1871 | *Porphyromonas endodontalis* ATCC 35406 | ZP_04389701.1 | 229495977 |
| 1872 | *Clostridium sporogenes* | ZP_02995751.1 | 187779278 |
| 1931 | *Porphyromonas asaccharolytica* DSM 20707 | ZP_07821123.1 | 313887434 |
| 1932 | *Odoribacter splanchnicus* DSM 20712 | YP_004253242.1 | 325280700 |

TABLE 27

BDO and 4-hydroxybutyrate (4HB) production of *E. coli* host strain 3744 containing several alternative CoA-dependant succinate semialdehyde dehydrogenase plasmid constructs. The plasmid construct denoted by only "pZS*13S" contains no CoA-dependant succinate semialdehyde dehydrogenase gene. Plasmid constructs denoted by pZS*13S followed by a number express the CoA-dependant succinate semialdehyde dehydrogenase gene denoted by such number. BDO and 4HB concentrations are in mM.

| Host strain | Plasmid | OD - 16 h | LCMS - 16 h 4HB | LCMS - 16 h BDO |
|---|---|---|---|---|
| 3744 | pZS*13S | 3.10 | 0.47 | 3.08 |
| 3744 | pZS*13S | 2.97 | 0.54 | 2.69 |
| 3744 | pZS*13S | 3.18 | 0.89 | 4.09 |
| 3744 | pZS*13S | 1.26 | 0.44 | 2.41 |
| 3744 | pZS*13S-035 | 3.63 | 7.29 | 30.80 |
| 3744 | pZS*13S-035 | 2.89 | 6.86 | 28.30 |
| 3744 | pZS*13S-035 | 3.22 | 6.64 | 28.40 |
| 3744 | pZS*13S-035 | 3.73 | 7.55 | 28.80 |
| 3744 | pZS*13S-049 | 1.87 | 10.50 | 23.30 |
| 3744 | pZS*13S-049 | 1.65 | 10.10 | 23.70 |
| 3744 | pZS*13S-049 | 1.87 | 10.80 | 23.60 |
| 3744 | pZS*13S-049 | 1.75 | 11.40 | 23.70 |
| 3744 | pZS*13S-1870 | 3.58 | 0.43 | 7.18 |
| 3744 | pZS*13S-1870 | 3.51 | 0.57 | 7.28 |
| 3744 | pZS*13S-1870 | 3.15 | 0.50 | 5.59 |
| 3744 | pZS*13S-1870 | 2.98 | 0.44 | 6.78 |
| 3744 | pZS*13S-1871 | 3.33 | 6.73 | 37.20 |
| 3744 | pZS*13S-1871 | 3.28 | 6.42 | 31.90 |
| 3744 | pZS*13S-1871 | 3.20 | 7.18 | 32.40 |
| 3744 | pZS*13S-1871 | 3.44 | 7.03 | 33.90 |
| 3744 | pZS*13S-1872 | 3.52 | 0.44 | 4.52 |
| 3744 | pZS*13S-1872 | 3.54 | 0.49 | 4.71 |
| 3744 | pZS*13S-1872 | 3.56 | 0.38 | 4.51 |
| 3744 | pZS*13S-1872 | 3.37 | 0.37 | 4.49 |

TABLE 27-continued

BDO and 4-hydroxybutyrate (4HB) production of *E. coli* host strain 3744 containing several alternative CoA-dependant succinate semialdehyde dehydrogenase plasmid constructs. The plasmid construct denoted by only "pZS*13S" contains no CoA-dependant succinate semialdehyde dehydrogenase gene. Plasmid constructs denoted by pZS*13S followed by a number express the CoA-dependant succinate semialdehyde dehydrogenase gene denoted by such number. BDO and 4HB concentrations are in mM.

| 3744 | pZS*13S-1872 | 3.47 | 0.50 | 4.32 |
|---|---|---|---|---|
| 3744 | pZS*13S-1872 | 3.58 | 0.56 | 4.68 |
| 3744 | pZS*13S-1872 | 3.47 | 0.49 | 4.27 |
| 3744 | pZS*13S-1872 | 3.90 | 0.43 | 4.51 |

| | | OD - 24 hr | LCMS - 24 h | LCMS - 24 h |
|---|---|---|---|---|
| 3744 | pZS*13S | 3.89 | 0.12 | 8.85 |
| 3744 | pZS*13S | 3.79 | 0.17 | 8.57 |
| 3744 | pZS*13S | 3.85 | 0.17 | 8.87 |
| 3744 | pZS*13S | 3.84 | 0.12 | 9.05 |
| 3744 | pZS*13S-1931 | 3.78 | 3.18 | 45.10 |
| 3744 | pZS*13S-1931 | 3.64 | 3.28 | 46.50 |
| 3744 | pZS*13S-1931 | 2.91 | 4.25 | 34.00 |
| 3744 | pZS*13S-1931 | 3.73 | 3.22 | 45.40 |
| 3744 | pZS*13S-1932 | 3.71 | 3.10 | 84.20 |
| 3744 | pZS*13S-1932 | 3.63 | 3.24 | 79.50 |
| 3744 | pZS*13S-1932 | 3.61 | 3.18 | 82.60 |
| 3744 | pZS*13S-1932 | 3.61 | 3.24 | 83.90 |

Example XXVII

Production of 4HB and BDO Upon Expression of Genes Encoding 4-Hydroxybutyrate Dehydrogenase Enzymes This example describes production of 4HB and BDO upon expression of genes encoding 4-hydroxybutyrate dehydrogenase enzymes.

Several heterologous 4-hydroxybutyrate dehydrogenase genes (Table 28) were expressed in *E. coli* from the pZS*-13S plasmid to allow a functional pathway from succinyl-CoA and alpha-ketoglutarate to 4-hydroxybutyrate and 1,4-butanediol. Host strain 3891 is based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). For this study, the *P. gingivalis* and *C. kluyveri* 4hbd genes were deleted in strain 3891. Additionally, strain 3891 contains a chromosomally integrated copy of 4-hydroxybutyryl-CoA transferase expressed from the pA promoter at the attB locus. It also contains a pPSX23R plasmid expressing 4-hydroxybutyryl-CoA reductase and 4-hydroxybutyraldehyde reductase.

Table 29 shows that expression of heterologous 4-hydroxybutyrate dehydrogenase genes enhances 4hb and/or BDO production in strain 3891 over the controls denoted by "pZS*13S". Cells were cultured using the 96 well-plate protocol described previously.

TABLE 28

Genes encoding functional 4-hydroxybutyrate dehydrogenase enzymes.

| Gene Number | Organism | Accession | GI |
|---|---|---|---|
| 36 | Porphyromonas gingivalis W83 | NP_904964.1 | 34540485 |
| 150 | Clostridium acetobutylicum ATCC 824 | NP_348201.1 | 15894852 |
| 1879 | Porphyromonas endodontalis ATCC 35406 | ZP_04389726.1 | 229496002 |
| 1880 | Porphyromonas asaccharolytica DSM 20707 | YP_004441566.1 | 332299645 |
| 1881 | Odoribacter splanchnicus DSM 20712 | YP_004253243.1 | 325280701 |
| 1882 | Eubacterium saphenum ATCC 49989 | ZP_05427218.1 | 255994083 |
| 1883 | Clostridium ljungdahlii DSM 13528 | YP_003782020.1 | 300857036 |
| 1884 | Clostridium perfringens ATCC 13124 | YP_694972.1 | 110800333 |
| 1888 | Clostridium difficile 630 | YP_001088853.1 | 126699956 |
| 1889 | Geobacter sulferreducens | NP_952425.1 | 39996474 |
| 1894 | Metallosphaera sedula DSM 5348 (ATCC 51363D-5) | YP_001191506.1 | 146304190 |

TABLE 29

BDO and 4-hydroxybutyrate (4HB) production of E.coli host strain 3891 containing several alternative 4-hydroxybutyrate dehydrogenase plasmid constructs. The plasmid construct denoted by only "pZS*13S" contains no 4-hydroxybutyrate dehydrogenase gene. Plasmid constructs denoted by pZS*13S followed by a number express the 4-hydroxybutyrate dehydrogenase gene denoted by such number. BDO and 4HB concentrations are in mM.

| Host | Plasmid | OD-16h | LCMS-16h 4HB | LCMS-16h BDO |
|---|---|---|---|---|
| 3891 | pZS*13S | 3.26 | 0.07 | 1.33 |
| 3891 | pZS*13S | 3.06 | 0.04 | 1.38 |
| 3891 | pZS*13S | 3.17 | 0.04 | 1.80 |
| 3891 | pZS*13S | 3.22 | 0.04 | 1.25 |
| 3891 | pZS*13S-036 | 3.11 | 7.19 | 15.90 |
| 3891 | pZS*13S-036 | 2.95 | 7.31 | 17.40 |
| 3891 | pZS*13S-036 | 3.17 | 7.00 | 16.40 |
| 3891 | pZS*13S-036 | 2.80 | 6.84 | 16.60 |
| 3891 | pZS*13S-150 | 2.99 | 2.58 | 31.20 |
| 3891 | pZS*13S-150 | 3.41 | 2.49 | 33.30 |
| 3891 | pZS*13S-150 | 3.11 | 2.88 | 32.40 |
| 3891 | pZS*13S-150 | 2.91 | 2.71 | 33.30 |
| 3891 | pZS*13S-1879 | 3.35 | 1.99 | 9.78 |
| 3891 | pZS*13S-1879 | 3.12 | 2.26 | 10.80 |
| 3891 | pZS*13S-1879 | 3.42 | 2.06 | 9.58 |
| 3891 | pZS*13S-1879 | 3.16 | 2.21 | 10.20 |
| 3891 | pZS*13S-1880 | 2.01 | 3.99 | 13.30 |
| 3891 | pZS*13S-1880 | 2.85 | 4.49 | 14.00 |
| 3891 | pZS*13S-1880 | 2.99 | 4.52 | 12.90 |
| 3891 | pZS*13S-1880 | 2.95 | 4.04 | 12.70 |
| 3891 | pZS*13S-1881 | 3.18 | 3.73 | 7.00 |
| 3891 | pZS*13S-1881 | 2.95 | 3.56 | 7.64 |
| 3891 | pZS*13S-1881 | 3.03 | 3.40 | 6.98 |
| 3891 | pZS*13S-1881 | 2.96 | 3.68 | 7.50 |
| 3891 | pZS*13S-1882 | 3.20 | 3.62 | 22.70 |
| 3891 | pZS*13S-1882 | 3.13 | 3.85 | 24.10 |
| 3891 | pZS*13S-1882 | 3.33 | 3.34 | 22.20 |
| 3891 | pZS*13S-1882 | 2.60 | 3.67 | 19.80 |
| 3891 | pZS*13S-1883 | 3.53 | 2.47 | 24.00 |
| 3891 | pZS*13S-1883 | 3.39 | 1.79 | 24.60 |
| 3891 | pZS*13S-1883 | 3.41 | 2.20 | 27.10 |
| 3891 | pZS*13S-1883 | 3.33 | 2.13 | 22.00 |
| 3891 | pZS*13S-1884 | 3.09 | 1.13 | 30.50 |
| 3891 | pZS*13S-1884 | 3.02 | 1.20 | 33.80 |
| 3891 | pZS*13S-1884 | 3.76 | 1.34 | 34.40 |
| 3891 | pZS*13S-1884 | 3.15 | 1.40 | 36.80 |
| 3891 | pZS*13S-1888 | 3.11 | 0.28 | 31.40 |
| 3891 | pZS*13S-1888 | 3.04 | 0.22 | 30.70 |
| 3891 | pZS*13S-1888 | 3.09 | 0.21 | 29.90 |
| 3891 | pZS*13S-1888 | 3.33 | 0.30 | 31.50 |
| 3891 | pZS*13S-1889 | 3.17 | 1.03 | 19.20 |
| 3891 | pZS*13S-1889 | 3.04 | 1.12 | 18.70 |
| 3891 | pZS*13S-1889 | 3.14 | 1.05 | 17.40 |
| 3891 | pZS*13S-1889 | 3.01 | 1.25 | 18.10 |
| 3891 | pZS*13S-1894 | 3.03 | 0.85 | 13.70 |

TABLE 29-continued

BDO and 4-hydroxybutyrate (4HB) production of *E.coli* host strain 3891 containing several alternative 4-hydroxybutyrate dehydrogenase plasmid constructs. The plasmid construct denoted by only "pZS*13S" contains no 4-hydroxybutyrate dehydrogenase gene. Plasmid constructs denoted by pZS*13S followed by a number express the 4-hydroxybutyrate dehydrogenase gene denoted by such number. BDO and 4HB concentrations are in mM.

| Host | Plasmid | OD-16h | LCMS-16h 4HB | LCMS-16h BDO |
|------|---------|--------|--------------|--------------|
| 3891 | pZS*13S-1894 | 2.91 | 0.67 | 13.00 |
| 3891 | pZS*13S-1894 | 3.00 | 1.04 | 12.80 |
| 3891 | pZS*13S-1894 | 3.03 | 0.86 | 12.90 |

Example XXVIII

Production of 4HB and BDO Upon Expression of Genes Encoding 4-Hydroxybutyrate Transferase Enzymes This example describes production of 4hb and BDO upon expression of genes encoding 4-hydroxybutyrate transferase enzymes.

Several heterologous 4-hydroxybutyrate transferase genes (Table 30) were expressed in *E. coli* from either the pZS*-13S or F' plasmid to allow a functional pathway from alpha-ketoglutarate and succinyl-CoA to 1,4-butanediol. Host strains include 1269, 2731 Δcat2, and 1654. These host strains are based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P gingivalis* (encoding 4-hydroxybutyrate dehydrogenase), and 4hbd from *Clostridium kluyveri* (encoding 4-hydroxybutyrate dehydrogenase). Strains 1269, 2731 Δcat2, and 1654 were all tested with 4-hydroxybutyryl-CoA reductase and 4-hydroxybutyraldehyde reductase expressed from the pZS*-13S plasmid. Tables 31, 32, and 33 show that expression of heterologous 4-hydroxybutyrate transferase genes allows BDO production in strains 1269, 2731 Δcat2, and 1654, respectively. Cells were cultured using the 96 well-plate protocol described previously.

TABLE 30

Genes encoding functional 4-hydroxybutyrate transferase enzymes.

| Gene Number | Organism | Accession | GI |
|---|---|---|---|
| 34 | *Porphyromonas gingivalis* W83 | NP_904965 | 34540486 |
| 1210 | *Clostridium difficile* 630 | YP_001088854 | 126699957 |
| 1769 | *Eubacterium saphenum* ATCC 49989 | ZP_05427217 | 255994082 |
| 1772 | *Porphyromonas endodontalis* ATCC 35406 | ZP_04389695 | 229495971 |
| 1774 | *Anaerostipes caccae* DSM 14662 | ZP_02417601 | 167745474 |
| 33B | *Clostridium aminobutyricum* | CAB60036 | 188032706 |
| 1801 | *Fusobacterium nucleatum* subsp. *vincentii* ATCC 49256 | ZP_00144049 | 34763077 |
| 1803 | *Fusobacterium ulcerans* ATCC 49185 | ZP_07928926 | 317064441 |
| 1804 | *Fusobacterium varium* ATCC 27725 | ZP_08693772 | 340757169 |
| 1805 | *Odoribacter splanchnicus* DSM 20712 | YP_004253244 | 325280702 |
| 1807 | *Porphyromonas gingivalis* | YP_001930004 | 188995752 |
| 1808 | *Fusobacterium gonidiaformans* ATCC 25563 | ZP_07914775 | 315918535 |
| 1809 | *Acetonema longum* DSM 6540 | ZP_08623452 | 338811223 |

The nucleotide sequences for 1210C and 033B are provided below as these were codon-optimized for expression in *E. coli*.

33B:
(SEQ ID NO: 174)

```
atggactggaagaagatctatgaagacagaacctgcactgcagatgaagc agtaaagagcattaagtcaggtgaccgcgtgctgtttgcgcactgtgttg ctgaaccgccagttctggtagaagcaatggttgcgaatgcagctgcatac aagaatgtcacggtttcacacatggttacccttggtaagggtgaatactc aaaaccagaatataaagaaaactttacttttgaaggttggtttaccagcc cttcaacacgtggatccattgcagaaggacacggacagtttgtccctgta ttcttccacgaggtaccatctttaatccgtaaagacattttccatgttga tgtattcatggtaatggtatcccgcccagatcataacggtttctgctgtg tgggtgtatcttctgactataccatgcaggctatcaaatcagcaaaaatt gtactggctgaagtgaatgatcaggtacctgtagtttatggcgatacctt tgttcacgttagtgaaatcgacaagttcgttgaaacttcacatccactgc cagaaatcggtctgccgaagatcggtgaagtagaagctgctattggtaag cactgcgcttcgctgatcgaagatggttccacattacagcttggtatcgg cgctattccggatgctgtactttcacagcttaaggacaagaaacaccttg gtatccactctgaaatgatttccgacggtgttgttgatcttttacgaagca ggcgttattgactgcagccaaaagtctatcgacaaaggcaaaatggcaat aacattcttaatgggaacgaagcgtctttatgatttcgctgcaaacaatc caaaggttgaattaaagccggttgactacatcaatcatccatctgtagtt gcacagtgcagcaaaatggtttgcatcaatgcttgcttgcaagttgattt tatgggtcagattgtctccgatagtattggcacaaagcagttctccggcg taggcggtcaggttgacttcgtacgcggtgcatccatgtctattgacggc aaaggtaaagcgatcatcgcgatgccttccgttgcaaagaagaaagatgg cagtatgatttcgaagatcgttccattcatcgatcacggtgcagctgtaa ctacatcccgtaacgatgcggactatgtcgtaacggaatatggtattgct gaaatgaagggtaagtcgttacaggaccgcgcacgcgcgttaatcaatat tgcccaccctgatttcaaagatgaattaaaggctgaatttgaaaagcgct tcaacgcggcattctaa.
```

1210C:
(SEQ ID NO: 175)

```
atgagctggcaagaactgtatcaaagtaaattatgttcagccacagaagc ggtaaaacagattaaaaacggtgataccgtggtatttgcccattgtgtag gtgaaccgcctgcactggtggaggcgatgattgaaaatgctgaacaatat
```

-continued

```
aaagatgttgagattaaacatatggttagcctgggtagtggtggttatac tgcgaaagggatggaagcgcattttcgcgtaaatccaatgtttgtcagcg gcaatgtacgtaaggcgattgaaaatggcgatggtgattttacacctgca ttcttccatgaagtaccaaagttgctgcgtgaaaaacgtctgaaatgtga tgttgttctggcacaggtaacgccaccagatgaacatggttattgttcgc tgggaacaagcgttgattatacctatgaagccattaaaaccgcgcgcacc gtaattgttcaggtgaatgaccagtttcctcgcacctatggtgaggtggt gcatgtcagcgagtttgactatatcgttgaaaaatcacaaccgctgtttg aactgcaacctgcaaagattggcgaagttgaagaagcgattggtaaaaat tgtgcctcgctgattgaagatggtagcacgttacagctggggattggtgg gattccggatgcggtgatgttatttctgactgataaaaaagatttaggga ttcatagcgaaatgattagcgatggcacgctggcgctttatgaaaaaggt
```

-continued

```
gttattaatggtaaatataaaaattttgataaagaaaaaatgacggttac cttcctgatgggtactaaaaaactgtatgactttgccaataataacccgg cagtagaggtaaaaccggtagactatgtgaatcatccggcaattatcatg aaacaacataagatggtttctattaatagcgccattcaggttgatttaat ggggcaggtggttgcagaggcgatgggactgcgccaattttccggtgttg gcggtcaggttgactttattcgtggcgtgtcgatgggtgaagatggcaag gcgattatcgcgatgccttcaatcactacaaaaaaagatggtacggtaat tagcaaaatcgtctctattgtcgatgaaggtgcaccgattaccacctcac gtaatgatgttgattatattgtcacagaatacggtattgcagaattaaaa ggcaaatcgctgcgtgaacgcgcacgtaatctgattaatattgctcatcc atcggtacgtgaatcgctggcagtagaatttgaaaagcgctttaaagaga aatattaa.
```

TABLE 31

BDO, GBL, and 4-hydroxybutyrate (4HB) production of *E.coli* host strain 1269 containing two alternative 4-hydroxybutyrate transferase plasmid constructs. The plasmid construct denoted by only "pZA33S (empty)" contains no 4-hydroxybutyrate transferase gene. Plasmid constructs denoted by F' followed by a number express the 4-hydroxybutyrate transferase gene denoted by such number. BDO and 4HB concentrations are in mM.

| Host Strain | Plasmid | OD 24h | LCMS-24h 4HB | LCMS-24h BDO | LCMS-24h GBL |
|---|---|---|---|---|---|
| 1269 | pZA33S (empty) | 2.92 | 27.60 | 0.00 | 0.00 |
| 1269 | pZA33S (empty) | 2.12 | 23.80 | 0.59 | 0.07 |
| 1269 | pZA33S (empty) | 2.72 | 28.80 | 2.13 | 0.03 |
| 1269 | pZA33S (empty) | 2.32 | 30.50 | 0.14 | 0.00 |
| 1269 | F'34 | 1.76 | 2.42 | 22.20 | 0.87 |
| 1269 | F'34 | 1.70 | 2.34 | 21.00 | 0.88 |
| 1269 | F'34 | 2.09 | 3.23 | 23.50 | 1.21 |
| 1269 | F'34 | 3.83 | 2.77 | 51.30 | 5.01 |
| 1269 | F'1210C | 1.99 | 2.84 | 28.20 | 1.73 |
| 1269 | F'1210C | 1.64 | 2.73 | 27.30 | 1.61 |
| 1269 | F'1210C | 1.89 | 4.28 | 32.30 | 2.59 |
| 1269 | F'1210C | 3.47 | 3.76 | 56.38 | 7.22 |

TABLE 32

BDO, GBL, and 4-hydroxybutyrate (4HB) production of *E.coli* host strain 2731 Δcat2 containing alternative 4-hydroxybutyrate transferase plasmid constructs. Plasmid constructs denoted by pZS*13S- followed by a number express the 4-hydroxybutyrate transferase gene denoted by such number. The pZS*13S-backbone also expresses functional 4-hydroxybutyryl-CoA reductase and 4-hydroxybutyraldehyde dehydrogenase genes. BDO and 4HB concentrations are in mM.

| Host Strain | Plasmid | OD 19h | LCMS-19h 4HB | LCMS-19h BDO | LCMS-19h GBL |
|---|---|---|---|---|---|
| 2731 Δcat2 | pZS*13S-1769 | 3.75 | 1.1 | 24.9 | 0.1 |
| 2731 Δcat2 | pZS*13S-1769 | 3.84 | 1.3 | 23.9 | 0.1 |
| 2731 Δcat2 | pZS*13S-1769 | 4.10 | 1.3 | 23.0 | 0.1 |
| 2731 Δcat2 | pZS*13S-1769 | 4.14 | 1.1 | 27.3 | 0.1 |
| 2731 Δcat2 | pZS*13S-1772 | 4.33 | 2.9 | 36.7 | 0.2 |
| 2731 Δcat2 | pZS*13S-1772 | 4.37 | 2.3 | 37.9 | 0.3 |
| 2731 Δcat2 | pZS*13S-1772 | 4.02 | 2.7 | 40.4 | 0.3 |
| 2731 Δcat2 | pZS*13S-1772 | 3.59 | 3.4 | 27.4 | 0.2 |
| 2731 Δcat2 | pZS*13S-1774 | 4.10 | 2.2 | 29.9 | 0.2 |
| 2731 Δcat2 | pZS*13S-1774 | 3.93 | 1.9 | 29.2 | 0.3 |
| 2731 Δcat2 | pZS*13S-1774 | 4.26 | 2.5 | 31.5 | 0.3 |
| 2731 Δcat2 | pZS*13S-1774 | 4.76 | 1.6 | 29.8 | 0.2 |

TABLE 33

BDO, GBL, and 4-hydroxybutyrate (4HB) production of E.coli host strain 1654 containing alternative 4-hydroxybutyrate transferase plasmid constructs. Plasmid constructs denoted by pZS*13S- followed by a number express the 4-hydroxybutyrate transferase gene denoted by such number. The pZS*13S-backbone also expresses functional 4-hydroxybutyryl-CoA reductase and 4-hydroxybutyraldehyde dehydrogenase genes. BDO and 4HB concentrations are in mM.

| Host Strain | Plasmid | OD 19h | LCMS-19h 4HB | LCMS-19h BDO | LCMS-19h GBL |
|---|---|---|---|---|---|
| 1654 | pZS*-13S-033B | 3.96 | 1.47 | 26.00 | 1.69 |
| 1654 | pZS*-13S-033B | 4.17 | 1.32 | 23.90 | 1.54 |
| 1654 | pZS*-13S-033B | 4.11 | 0.99 | 25.80 | 1.62 |
| 1654 | pZS*-13S-033B | 3.80 | 1.04 | 25.40 | 1.61 |
| 1654 | pZS*-13S-1801 | 3.68 | 1.88 | 21.80 | 1.61 |
| 1654 | pZS*-13S-1801 | 3.90 | 1.35 | 21.70 | 1.67 |
| 1654 | pZS*-13S-1801 | 3.76 | 1.76 | 20.90 | 1.55 |
| 1654 | pZS*-13S-1801 | 3.66 | 1.92 | 22.00 | 1.77 |
| 1654 | pZS*-13S-1803 | 3.69 | 1.71 | 27.60 | 1.80 |
| 1654 | pZS*-13S-1803 | 3.79 | 1.45 | 23.60 | 1.63 |
| 1654 | pZS*-13S-1803 | 3.64 | 1.09 | 24.80 | 1.72 |
| 1654 | pZS*-13S-1803 | 3.64 | 1.30 | 23.60 | 1.67 |
| 1654 | pZS*-13S-1804 | 3.74 | 1.27 | 26.00 | 1.83 |
| 1654 | pZS*-13S-1804 | 3.87 | 1.90 | 25.40 | 1.95 |
| 1654 | pZS*-13S-1804 | 4.04 | 1.48 | 22.80 | 1.65 |
| 1654 | pZS*-13S-1804 | 3.75 | 1.87 | 26.00 | 1.87 |
| 1654 | pZS*-13S-1805 | 3.84 | 1.47 | 25.20 | 1.47 |
| 1654 | pZS*-13S-1805 | 3.75 | 1.06 | 27.50 | 1.54 |
| 1654 | pZS*-13S-1805 | 3.08 | 1.67 | 22.00 | 1.26 |
| 1654 | pZS*-13S-1805 | 3.57 | 1.22 | 23.80 | 1.36 |
| 1654 | pZS*-13S-1807 | 3.24 | 0.00 | 4.80 | 0.40 |
| 1654 | pZS*-13S-1807 | 3.30 | 0.29 | 5.10 | 0.48 |
| 1654 | pZS*-13S-1807 | 3.36 | 0.17 | 4.68 | 0.39 |
| 1654 | pZS*-13S-1807 | 3.31 | 0.21 | 5.16 | 0.38 |
| 1654 | pZS*-13S-1808 | 3.38 | 2.39 | 24.50 | 1.20 |
| 1654 | pZS*-13S-1808 | 3.39 | 2.56 | 22.20 | 1.07 |
| 1654 | pZS*-13S-1808 | 3.45 | 2.16 | 22.40 | 1.10 |
| 1654 | pZS*-13S-1808 | 3.42 | 2.26 | 23.10 | 1.27 |
| 1654 | pZS*-13S-1809 | 4.26 | 1.52 | 18.10 | 0.93 |
| 1654 | pZS*-13S-1809 | 4.37 | 1.86 | 21.50 | 1.07 |
| 1654 | pZS*-13S-1809 | 3.51 | 1.67 | 16.00 | 0.81 |
| 1654 | pZS*-13S-1809 | 4.49 | 0.97 | 18.60 | 0.97 |

Example XXIX

Production of 4HB and BDO Upon Expression of Genes Encoding 4-Hydroxybutyryl-CoA Reductase Enzymes This example describes production of 4hb and BDO upon expression of genes encoding 4-hydroxybutyryl-CoA reductase enzymes.

Several heterologous 4-hydroxybutyryl-CoA reductase genes (Table 34) were expressed in E. coli from the pZS*-13S plasmid to allow a functional pathway from succinyl-CoA and alpha-ketoglutarate to 1,4-butanediol. Host strain 1889 is based on strain ECKh-432 whose construction is described above and in US20110045575. Notable modifications include deletions in adhE, ldhA, pflB, mdh, and arcA. Strain ECKh-432 also contains chromosomally integrated copies of sucD from Porphyromonas gingivalis (encoding CoA-dependant succinate semialdehyde dehydrogenase), sucA from Mycobacterium bovis (encoding alpha-ketoglutarate decarboxylase), 4hbd from P. gingivalis (encoding 4-hydroxybutyrate dehydrogenase), and 4hbd from Clostridium kluyveri (encoding 4-hydroxybutyrate dehydrogenase). Strain 1889 contains deletions in the native alcohol dehydrogenase genes adhP, yqhD, yahK, and yjgB. Additionally, strain 1889 contains a chromosomally integrated copy of 4-hydroxybutyryl-CoA transferase expressed from the pA promoter at the attB locus. Strain 1889 contains the F' plasmid expressing a functional 4-hydroxybutyraldehyde reductase gene. Strain 4269 contains a chromosomally integrated copy of a 4-hydroxybutyraldehyde reductase gene at the hemN locus under control of the p119 promoter.

Tables 35 and 36 show that expression of heterologous 4-hydroxybutyryl-CoA reductase genes enhances BDO production in strains 1889 and 4269, respectively, over the controls denoted by "pZS*13S". Cells were cultured using the 96 well-plate protocol described previously.

TABLE 34

Genes encoding functional 4-hydroxybutyryl-CoA reductase enzymes.

| Gene Number | Organism | Accession | GI |
|---|---|---|---|
| 025B | Clostridium beijerinckii NCIMB 8052 | YP_001310903.1 | 150018649 |
| 733 | Clostridium hylemonae DSM 15053 | ZP_03778292.1 | 225569267 |
| 744 | Clostridium methylpentosum DSM 5476 | ZP_03705305.1 | 225016072 |
| 787 | Eubacterium hallii DSM 3353 | ZP_03715465.1 | 225026273 |
| 865 | Ruminococcus obeum ATCC 29174 | ZP_01962381.1 | 153809713 |
| 778 | Bacillus selenitireducens MLS10 | YP_003701164.1 | 297585384 |
| 714 | Clostridium saccharoperbutylacetonicum N1-4 | AAP42563.1 | 31075383 |
| 707 | Lactobacillus brevis ATCC 367 | YP_795711.1 | 116334184 |
| 141 | Desulfatibacillum alkenivorans AK-01 | YP_002434126.1 | 218782808 |
| 133 | Clostridium phytofermentans ISDg | YP_001558295.1 | 160879327 |
| 715 | Clostridium bolteae ATCC BAA-613 | ZP_02089671.1 | 160942363 |

TABLE 34-continued

Genes encoding functional 4-hydroxybutyryl-CoA reductase enzymes.

| Gene Number | Organism | Accession | GI |
|---|---|---|---|
| 779 | *Photobacterium profundum* 3TCK | ZP_01222600.1 | 90414628 |
| 145 | *Citrobacter koseri* ATCC BAA-895 | YP_001452373.1 | 157145054 |
| 704 | *Salmonella enterica typhimurium* | NP_460996.1 | 16765381 |
| 777 | *Sebaldella termitidis* ATCC 33386 | YP_003307836.1 | 269119659 |
| 795 | *Fusobacterium nucleatum* subsp. *polymorphum* ATCC 10953 | ZP_04969437.1 | 254302079 |
| 706 | *Tolumonas auensis* DSM 9187 | YP_002892893.1 | 237808453 |
| 137 | *Rhodospirillum rubrum* ATCC 11170 | YP_426002.1 | 83592250 |
| 1993 | Metalibrary sp | N/A | N/A |

TABLE 35

BDO and 4-hydroxybutyrate (4HB) production of *E.coli* host strain 1889 containing several alternative 4-hydroxybutyryl-CoA reductase plasmid constructs. The plasmid construct denoted by only "pZS*13S" contains no 4-hydroxybutyryl-CoA reductase gene. Plasmid constructs denoted by pZS*13S followed by a number express the 4-hydroxybutyryl-CoA reductase gene denoted by such number. BDO and 4HB concentrations are in mM.

| Host | Plasmid | OD 24h | LCMS-24 hrs 4HB | LCMS-24 hrs BDO |
|---|---|---|---|---|
| 1889 | pZS*13S | 3.12 | 3.93 | 0 |
| 1889 | pZS*13S | 3.68 | 10.4 | 0.5 |
| 1889 | pZS*13S | 2.81 | 2.74 | 0 |
| 1889 | pZS*13S | 2.61 | 1.16 | 0 |
| 1889 | pZS*13S-025B | 3.25 | 0.87 | 8.42 |
| 1889 | pZS*13S-025B | 2.11 | 0.8 | 7.09 |
| 1889 | pZS*13S-025B | 3.01 | 0.65 | 7.38 |
| 1889 | pZS*13S-025B | 3.04 | 0.72 | 6.81 |
| 1889 | pZS*13S-733 | 1.67 | 1.07 | 1.64 |
| 1889 | pZS*13S-733 | 1.63 | 1.22 | 1.87 |
| 1889 | pZS*13S-733 | 2.16 | 1.16 | 1.89 |
| 1889 | pZS*13S-733 | 2.34 | 1.04 | 1.88 |
| 1889 | pZS*13S-744 | 2.75 | 0.63 | 2.17 |
| 1889 | pZS*13S-744 | 3.00 | 0.65 | 1.75 |
| 1889 | pZS*13S-744 | 2.75 | 0.5 | 1.72 |
| 1889 | pZS*13S-744 | 1.98 | 0.39 | 0.56 |
| 1889 | pZS*13S-787 | 2.63 | 0.88 | 1.82 |
| 1889 | pZS*13S-787 | 2.40 | 1 | 1.75 |
| 1889 | pZS*13S-787 | 2.88 | 1.06 | 2.41 |
| 1889 | pZS*13S-787 | 3.26 | 1.03 | 1.86 |
| 1889 | pZS*13S-865 | 2.60 | 0.95 | 1.71 |
| 1889 | pZS*13S-865 | 2.70 | 1.11 | 2.09 |
| 1889 | pZS*13S-865 | 2.69 | 0.98 | 1.4 |
| 1889 | pZS*13S-865 | 2.70 | 1.06 | 1.74 |
| 1889 | pZS*13S-778 | 2.76 | 1.15 | 5.79 |
| 1889 | pZS*13S-778 | 3.12 | 1.06 | 6.48 |
| 1889 | pZS*13S-778 | 2.83 | 1.08 | 4.98 |
| 1889 | pZS*13S-778 | 2.79 | 1.1 | 5.19 |
| 1889 | pZS*13S-714 | 2.60 | 0.63 | 6.55 |
| 1889 | pZS*13S-714 | 2.77 | 0.86 | 6.88 |
| 1889 | pZS*13S-714 | 2.67 | 0.77 | 6.51 |
| 1889 | pZS*13S-714 | 2.73 | 0.75 | 8.12 |
| 1889 | pZS*13S-707 | 1.39 | 0.3 | 1.56 |
| 1889 | pZS*13S-707 | 1.05 | 0.24 | 1.57 |
| 1889 | pZS*13S-707 | 1.99 | 0.26 | 1.62 |
| 1889 | pZS*13S-707 | 2.20 | 0.28 | 1.76 |
| 1889 | pZS*13S-141 | 2.54 | 1.08 | 2.13 |
| 1889 | pZS*13S-141 | 2.72 | 1 | 2.01 |
| 1889 | pZS*13S-141 | 2.54 | 1.04 | 1.9 |
| 1889 | pZS*13S-141 | 2.34 | 0.97 | 1.77 |
| 1889 | pZS*13S-133 | 2.63 | 0.7 | 2.69 |
| 1889 | pZS*13S-133 | 1.79 | 0.73 | 2.5 |
| 1889 | pZS*13S-133 | 3.04 | 0.69 | 2.26 |
| 1889 | pZS*13S-133 | 3.21 | 0.65 | 2.84 |
| 1889 | pZS*13S-715 | 2.79 | 1.03 | 2.31 |
| 1889 | pZS*13S-715 | 2.67 | 1.13 | 1.55 |
| 1889 | pZS*13S-715 | 2.90 | 1.02 | 1.6 |
| 1889 | pZS*13S-715 | 3.10 | 1.17 | 2.26 |
| 1889 | pZS*13S-779 | 3.21 | 8.88 | 0.46 |
| 1889 | pZS*13S-779 | 2.84 | 10.5 | 0.63 |
| 1889 | pZS*13S-779 | 3.98 | 11.9 | 0.84 |
| 1889 | pZS*13S-779 | 4.55 | 13.5 | 1.15 |
| 1889 | pZS*13S-145 | 2.08 | 0.53 | 0.76 |
| 1889 | pZS*13S-145 | 2.65 | 0.66 | 0.72 |
| 1889 | pZS*13S-145 | 2.74 | 0.55 | 0.63 |

TABLE 35-continued

BDO and 4-hydroxybutyrate (4HB) production of E.coli host strain 1889 containing several alternative 4-hydroxybutyryl-CoA reductase plasmid constructs. The plasmid construct denoted by only "pZS*13S" contains no 4-hydroxybutyryl-CoA reductase gene. Plasmid constructs denoted by pZS*13S followed by a number express the 4-hydroxybutyryl-CoA reductase gene denoted by such number. BDO and 4HB concentrations are in mM.

| Host | Plasmid | OD 24h | LCMS-24 hrs 4HB | LCMS-24 hrs BDO |
|---|---|---|---|---|
| 1889 | pZS*13S-145 | 3.08 | 0.7 | 0.68 |
| 1889 | pZS*13S-704 | 2.49 | 0.93 | 1.65 |
| 1889 | pZS*13S-704 | 2.08 | 0.89 | 1.81 |
| 1889 | pZS*13S-704 | 2.97 | 0.76 | 1.58 |
| 1889 | pZS*13S-704 | 3.35 | 0.9 | 2.32 |
| 1889 | pZS*13S-777 | 2.65 | 1.45 | 0.94 |
| 1889 | pZS*13S-777 | 3.03 | 1.89 | 1.5 |
| 1889 | pZS*13S-777 | 3.36 | 2.16 | 1.79 |
| 1889 | pZS*13S-777 | 3.10 | 1.93 | 1.6 |
| 1889 | pZS*13S-795 | 2.60 | 3.22 | 1.55 |
| 1889 | pZS*13S-795 | 3.43 | 4.54 | 1.96 |
| 1889 | pZS*13S-795 | 3.33 | 4.24 | 1.93 |
| 1889 | pZS*13S-795 | 2.87 | 2.15 | 0.97 |
| 1889 | pZS*13S-706 | 2.67 | 0.96 | 1.36 |
| 1889 | pZS*13S-706 | 2.41 | 1.52 | 2.64 |
| 1889 | pZS*13S-706 | 2.94 | 1.4 | 2.56 |
| 1889 | pZS*13S-706 | 2.71 | 0.85 | 0.89 |
| 1889 | pZS*13S-137 | 2.85 | 1.76 | 1.4 |
| 1889 | pZS*13S-137 | 3.04 | 2.31 | 2.21 |
| 1889 | pZS*13S-137 | 3.00 | 1.89 | 1.56 |
| 1889 | pZS*13S-137 | 2.45 | 0.55 | 0.17 |

TABLE 36

BDO and 4-hydroxybutyrate (4HB) production of E. coli host strain 4269 containing either no heterologous 4-hydroxybutyryl-CoA reductase gene (i.e., pZS*13S) or expressing the 4-hydroxybutyryl-CoA reductase gene, 1993, from the pZS* plasmid under control of the p100 promoter. The gene sequence for 1993 is provided in the bottom column of the table. BDO and 4HB concentrations are in mM.

| Host Plasmid | OD 24 h | LCMS-24 hrs 4HB | LCMS-24 hrs BDO |
|---|---|---|---|
| 4269 pZS*13S | 3.12 | 49.3 | 1.9 |
| 4269 pZS*13S | 3.08 | 50.7 | 1.7 |
| 4269 pZS*13S | 3.31 | 48.2 | 3.0 |
| 4269 pZS*13S | 3.18 | 55.7 | 3.2 |
| 4269 pZS*13S-p100-1993 | 3.88 | 13.1 | 37.2 |
| 4269 pZS*13S-p100-1993 | 3.58 | 18.3 | 44.3 |
| 4269 pZS*13S-p100-1993 | 3.40 | 17.3 | 46.9 |
| 4269 pZS*13S-p100-1993 | 3.40 | 16.0 | 46.5 |

Gene sequence for 1993:

atggatttgaagctgaccgatgcggacgttgaggcaatcgtagcgcaagt catggctaacattgagcgccgtctgggtagcgcggaagcgggcagcgcag catccgctgcgtcgccggcaccggctgcgccggttcgtaccgctccggt ggcagcccggcagccagcccgcgtccggagtacggtgtttttgatcgtgc ggaggatgcagtcgccgctgccgccgaagctcaggaagccttcctgcgcc agtgtcgtctgcaagaccgtgagcgcattctgcgtgccatccgtgaagag actctggcacgcaaggaagaattggcacgcctgatttgggaggaaacgaa gctgggtcgcttggaacacaaaattgcaaagctggaattgacggcgctga aaacccgggtacggaggatctgcgcaccgaggcatttagcggcgacaac ggcctgaccatcgtcgaacatgcgccgtacggtgtgattggcgcggttac cccggttacgaaccctgcggagactattatcaacaacgcgatcggcatgc tggcaagcggtaatgcagtggtgttcaacgtgcaccctagcgctaaacgt tgctccgcgtataccgtccagatgatcaataaagcagtgatggcagcggg tggtccgccgaatctggttacgatggttcgcgagccgaccatggaaaccc tgaatgcgatcatccgcagcccgagcgtgaagctgctggtgggcaccggc ggtccgggtctggttagcaccctgctgcgctctggtaagaaagcgattgg tgcgggtgcgggcaatccgccggtcgttgtggatgataccgccgacctgg agcatgcggcaaaggaaatcatcaaaggcgcgtcctttgacaacaatatt ctgtgtattgcggagaaagaggttttttgtggttgataaagcggccgacgg tctgatctatcacatgctggataacggcgcatacatgctgggtcgtgacg agctggagaaggtgatgcaattcgcgctgaccgcggacgaaagccagggc ggtgcgggttgctctattgatccgcgtcgtgcgtggcatgtgactaagga gtgggtgggcaaagatgcgcgcttgttcctggagaagattggtgtcaaga ctgaccgtccggttgacttgctgttgtgcgaggttgactttgaccacccg TABLE 36-continued BDO and 4-hydroxybutyrate (4HB) production of
E. coli host strain 4269 containing either no
heterologous 4-hydroxybutyryl-CoA reductase
gene (i.e., pZS*13S) or expressing the
4-hydroxybutyryl-CoA reductase gene, 1993, from
the pZS* plasmid under control of the p100
promoter. The gene sequence for 1993 is
provided in the bottom column of the table.
BDO and 4HB concentrations are in mM.

ttcgtgcagctggaacaaatgatgccagtactgccgattgttcgtgtccg tgacctggatgaagccatcgtatggccgtccgtgcggagcacggcaatcg tcacaccgcaattatgcatagccgtaacgtggacaatctgacccgttttg cccgtgccattgccacgaccatcttcgtcaaaaacgcaagcagcttggcg ggtgttggttatggcggtgaaggttttaccaccatgacgatcgccggtcc aacgggcgagggtctgacgtcggctcgtacgttcacgcgcaaagtccgct gtgtcctggcggacggcggtttccgtatcgttggttaa
(SEQ ID NO: 176)

Example XXX

Production of 4HB and BDO Upon Expression of Genes Encoding 4-Hydroxybutyraldehyde Reductase Enzymes This example describes production of 4hb and BDO upon expression of genes encoding 4-hydroxybutyraldehyde reductase enzymes.

Several heterologous 4-hydroxybutyraldehyde reductase genes (Table 37) were expressed in *E. coli* from the pZS*-13S plasmid to allow a functional pathway from succinyl-CoA and alpha-ketoglutarate to 1,4-butanediol. Host strain 1889 is based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). Strain 1889 contains deletions in the native alcohol dehydrogenase genes adhP, yqhD, yahK, and yjgB. Additionally, strain 1889 contains a chromosomally integrated copy of 4-hydroxybutyryl-CoA transferase expressed from the pA promoter at the attB locus. Table 38 shows that expression of heterologous 4-hydroxybutyraldehyde reductase genes enhances BDO production in strain 1889 over the controls denoted by "pZS*13S". Cells were cultured using the 96 well-plate protocol described previously.

TABLE 37

Genes encoding functional 4-hydroxybutyraldehyde reductase enzymes.

| Gene Number | Organism | Accession | GI |
|---|---|---|---|
| 12 | *Escherichia coli* K-12 MG1655 | AAC76047.1 | 1789386 |
| 956 | *Clostridium beijerinckii* NCIMB 8052 | YP_001309304.1 | 150017050 |
| 1247 | *Clostridium saccharobutylicum* | P13604.1 | 113352 |
| 1248 | *Clostridium asparagiforme* DSM 15981 | ZP_03760651.1 | 225405462 |
| 1250 | *Clostridium bolteae* ATCC BAA-613 | ZP_02083621.1 | 160936248 |
| 1251 | *Clostridium cellulovorans* 743B | YP_003845251.1 | 302876618 |
| 1256 | *Clostridium hiranonis* DSM 13275 | ZP_03294286.1 | 210624270 |
| 1259 | *Clostridium methylpentosum* DSM 5476 | ZP_03705769.1 | 225016577 |
| 1364 | *Atopobium parvulum* DSM 20469 | YP_003179160.1 | 257783943 |
| 1365 | *Tolumonas auensis* DSM 9187 | YP_002893476.1 | 237809036 |
| 1366 | *Clostridium carboxidivorans* P7 | ZP_05394983.1 | 255528157 |

TABLE 38

BDO and 4-hydroxybutyrate (4HB) production of *E.coli* host strain 1889 containing several alternative 4-hydroxybutyraldehyde reductase plasmid constructs. The plasmid construct denoted by only "pZS*13S-" contains no 4-hydroxybutyraldehyde reductase gene but does express a 4-hydroxybutyryl-CoA reductase gene. Plasmid constructs denoted by pZS*13S- followed by a number express both 4-hydroxybutyryl-CoA reductase and the 4-hydroxybutyraldehyde reductase gene denoted by such number. BDO and 4HB concentrations are in mM.

| Host | Plasmid | OD 24h | LCMS-24h 4HB | LCMS-24h BDO |
|---|---|---|---|---|
| 1889 | pZS*13S | 4.68 | 21.5 | 0.4 |
| 1889 | pZS*13S | 4.33 | 15.9 | 0.1 |
| 1889 | pZS*13S | 4.83 | 18.9 | 0.3 |
| 1889 | pZS*13S | 4.25 | 19.8 | 0.6 |
| 1889 | pZS*13S-956 | 4.45 | 2.4 | 52.0 |
| 1889 | pZS*13S-956 | 4.92 | 3.5 | 52.1 |
| 1889 | pZS*13S-956 | 4.65 | 4.2 | 42.9 |
| 1889 | pZS*13S-956 | 5.37 | 4.7 | 54.2 |
| 1889 | pZS*13S-1247 | 4.99 | 2.4 | 46.6 |
| 1889 | pZS*13S-1247 | 5.38 | 2.3 | 42.5 |
| 1889 | pZS*13S-1247 | 5.68 | 2.1 | 38.6 |
| 1889 | pZS*13S-1247 | 5.18 | 2.0 | 40.4 |
| 1889 | pZS*13S-1248 | 4.25 | 2.8 | 17.6 |

TABLE 38-continued

BDO and 4-hydroxybutyrate (4HB) production of *E.coli* host strain 1889 containing
several alternative 4-hydroxybutyraldehyde reductase plasmid constructs. The plasmid construct
denoted by only "pZS*13S-" contains no 4-hydroxybutyraldehyde reductase gene but does
express a 4-hydroxybutyryl-CoA reductase gene. Plasmid constructs denoted by pZS*13S-
followed by a number express both 4-hydroxybutyryl-CoA reductase and the 4-
hydroxybutyraldehyde reductase gene denoted by such number. BDO and 4HB concentrations
are in mM.

| Host | Plasmid | OD 24h | LCMS-24h 4HB | LCMS-24h BDO |
|---|---|---|---|---|
| 1889 | pZS*13S-1248 | 4.4 | 1.9 | 17.8 |
| 1889 | pZS*13S-1248 | 3.06 | 2.1 | 17.3 |
| 1889 | pZS*13S-1248 | 4.22 | 2.0 | 19.5 |
| 1889 | pZS*13S-1250 | 4.76 | 0.9 | 30.4 |
| 1889 | pZS*13S-1250 | 5.05 | 1.0 | 30.9 |
| 1889 | pZS*13S-1250 | 4.67 | 1.1 | 28.5 |
| 1889 | pZS*13S-1250 | 5.57 | 1.1 | 33.5 |
| 1889 | pZS*13S-1251 | 4.68 | 2.0 | 49.9 |
| 1889 | pZS*13S-1251 | 4.65 | 2.0 | 45.3 |
| 1889 | pZS*13S-1251 | 4.86 | 1.7 | 42.6 |
| 1889 | pZS*13S-1251 | 4.76 | 1.9 | 42.7 |
| 1889 | pZS*13S-1256 | 4.63 | 15.7 | 11.9 |
| 1889 | pZS*13S-1256 | 4.48 | 16.2 | 12.6 |
| 1889 | pZS*13S-1256 | 5.1 | 15.0 | 12.8 |
| 1889 | pZS*13S-1256 | 5.51 | 15.3 | 13.4 |
| 1889 | pZS*13S-1259 | 5.01 | 1.0 | 33.7 |
| 1889 | pZS*13S-1259 | 5.29 | 1.1 | 28.9 |
| 1889 | pZS*13S-1259 | 5.49 | 1.3 | 29.5 |
| 1889 | pZS*13S-1259 | 5.25 | 1.2 | 31.5 |
| 1889 | pZS*13S-1364 | 5.52 | 5.0 | 48.8 |
| 1889 | pZS*13S-1364 | 5.12 | 8.3 | 47.7 |
| 1889 | pZS*13S-1364 | 5.47 | 7.1 | 42.2 |
| 1889 | pZS*13S-1364 | 5.48 | 7.8 | 46.0 |
| 1889 | pZS*13S-1365 | 5.49 | 1.1 | 33.1 |
| 1889 | pZS*13S-1365 | 5.65 | 0.7 | 37.7 |
| 1889 | pZS*13S-1365 | 6.08 | 1.1 | 34.8 |
| 1889 | pZS*13S-1365 | 5.5 | 0.9 | 28.6 |
| 1889 | pZS*13S-1366 | 5.13 | 2.2 | 52.6 |
| 1889 | pZS*13S-1366 | 4.76 | 2.4 | 56.1 |
| 1889 | pZS*13S-1366 | 4.93 | 2.2 | 56.9 |
| 1889 | pZS*13S-1366 | blank | 2.5 | 57.9 |

Figure 70:
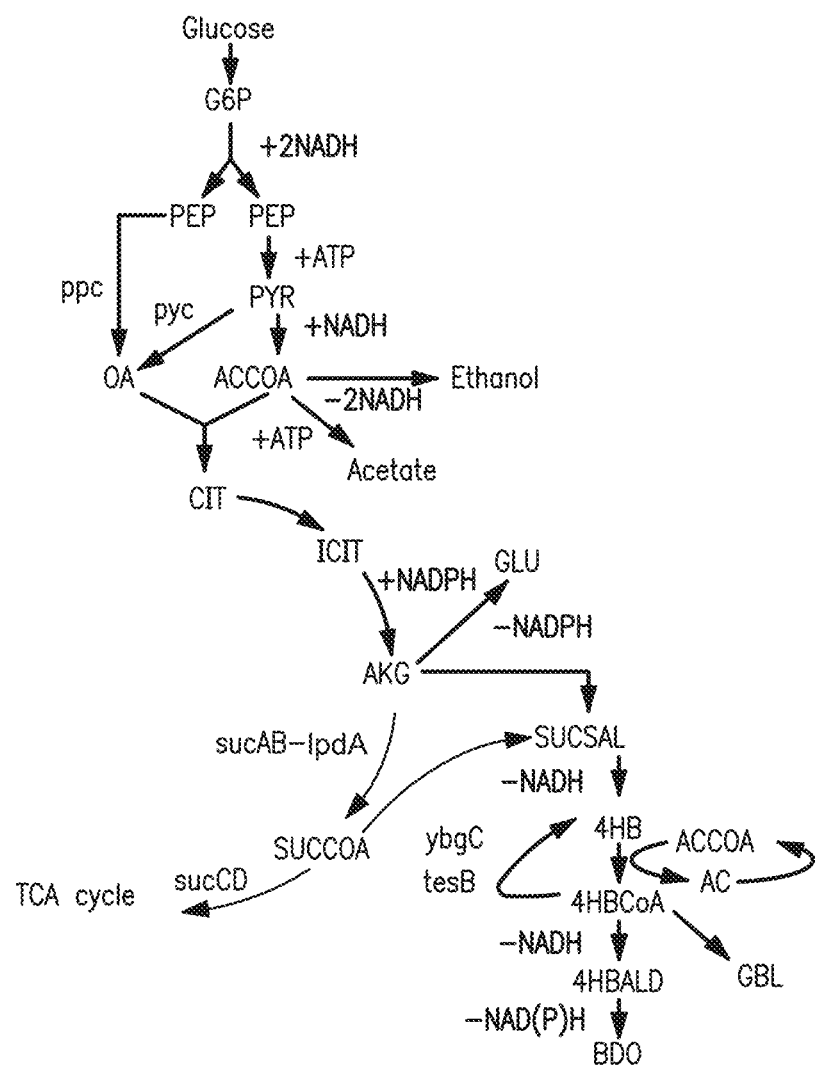
FIG. 70 shows an exemplary pathway for the formation of BDO from glucose. Abbreviations: G6P-glucose-6-phosphate, PEP-phosphoenolpyruvate, PYR-pyruvate, OA-oxaloacetate, ACCOA-acetyl-CoA, CIT-citrate, ICIT-isocitrate, AKG-alpha-ketoglutarate, SUCCOA-succinyl-CoA, SUCSAL-succinate semialdehyde, 4HB-4-hydroxybutyrate, 4HBCoA-4-hydroxybutyryl-CoA, 4HBALD-4hydroxybutyraldehyde, BDO-1,4-butanediol, GBL-gamma-butyrolactone. Genes of interest: ppc-PEP carboxylase, sucCD-succinyl-CoA synthetase, sucAB-lpdA-subunits of the AKG dehydrogenase complex, ybgC, tesB-acyl-CoenzymeA thioesterases

In the examples below, additional genetic manipulations are described that were made in the host strain to improve the yield of BDO on glucose. The key genes for deletion and overexpression are shown in FIG. 70.

Starting from the TCA cycle intermediate, alpha-ketoglutarate (AKG), there are two ways to channel flux into the BDO pathway. The first one comprises of an α-ketoacid decarboxylase that decarboxylates AKG into succinate semialdehyde and subsequently reduces it to 4-hydroxybutyrate (4HB). An alternative way to get to 4HB is via AKG dehydrogenase which transforms AKG into succinyl-CoA. This is then reduced to succinate semialdehye via succinate semialdehdye dehydrogenase and then to 4HB. 4HB can then be activated to 4-hydroxybutyryl-CoA (4-HBCoA) via a transferase that transfers the CoA from acetyl-CoA. 4-HB-CoA is reduced to 4-hydroxybutyraldehyde via an aldehyde dehydrogenase (ALD). The aldehyde is finally reduced to 1,4-butanediol (BDO) using an alcohol dehydrogenase (ADH).

Example XXXI

Overexpression of Phosphoenolpyruvate Carboxylase

This example describes overexpression of phosphoenolpyruvate (PEP) carboxylase. See corresponding example in WO2013/186402.

ppc refers to a gene that encodes for phosphoenolpyruvate (PEP) carboxylase activity. The net reaction involves the conversion of PEP and bicarbonate into oxaloacetate and phosphate. The overexpression of PEP carboxylase leads to conversion of more phosphoenolpyruvate (PEP) into OAA, thus reducing the flux from PEP into pyruvate and subsequently into acetyl-CoA. This leads to increased flux into the TCA cycle and thus into the pathway. Further, this overexpression also decreases the intracellular acetyl-CoA pools available for the ethanol-forming enzymes to work with, thus reducing the formation of ethanol and acetate. The increased flux towards oxaloacetate also helps reduce pyruvate and alanine secretion. Additionally, increased availability of oxaloacetate can reduce the cellular needs for respiration and also the amount of carbon lost as $CO_2$. The gene ppc was cloned on the plasmid pZS*-13S as described above.

Figure 71:
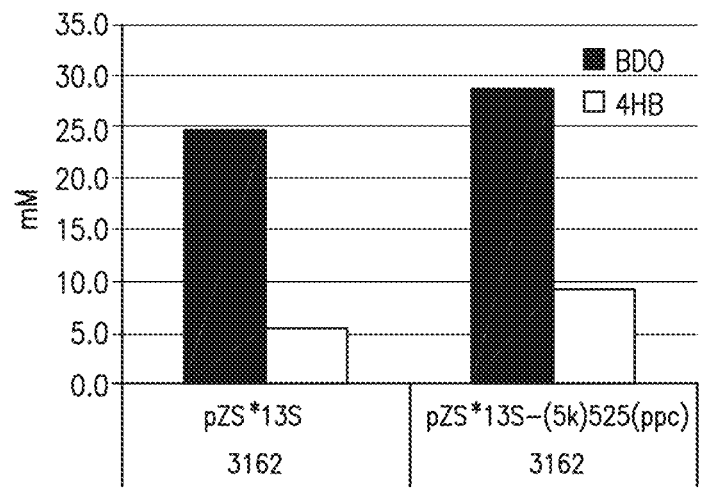
FIG. 71 shows the average BDO and 4HB numbers from four replicates of a 4HB producing host strain that had the gene ppc overexpressed compared with the corresponding averages from four replicates of the control strain.
Figure 72:
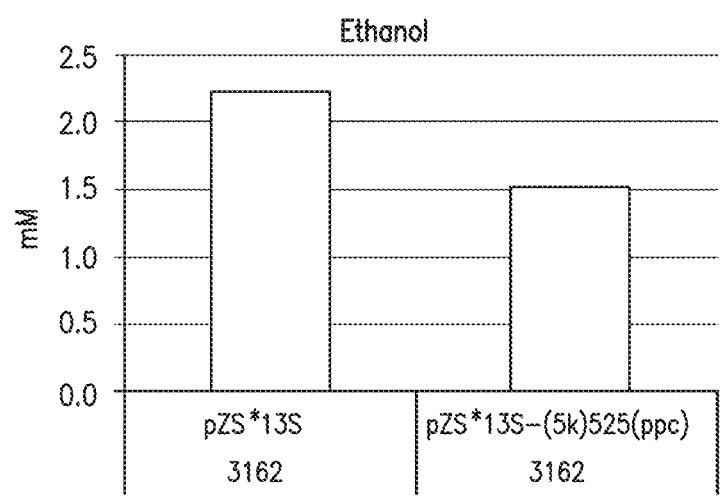
FIG. 72 shows the reduction in the average ethanol numbers from the four replicates of the strain that had ppc overexpressed and compared with those from the control.

Table 39 shows the BDO production in 96-well plates from the strain 3162 from 4 replicates. The gene ppc (#525) was overexpressed on pZS* with a pA promoter as described before and an RBK variant 5K was created. Host strain 3162 is based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). Strain 3162 contains deletions in the native alcohol dehydrogenase genes adhP, yqhD, yahK, and yjgB. Additionally, strain 3162 contains a chromosomally integrated copy of 4-hydroxybutyryl-CoA transferase expressed from the pA promoter at the attB locus. It also has deletions of cytochrome oxidases, cyoABCD and appBC. The aldehyde dehydrogenase and alcohol dehydrogenase genes for converting 4-hydroxybutyryl-CoA into 4-hydoxybutyraldehyde and subsequently to 1,4-butanediol (BDO) are expressed on the pPSX23R plasmid. The gene candidates for these enzyme steps have already been described. FIG. 71 shows the average BDO and 4HB for the culture and compares it to 4 replicates from the control strain 3162. The same comparison is made in FIG. 72 for the ethanol numbers. Higher BDO and 4HB were observed in cells with ppc overexpressed. As expected, lower ethanol numbers were seen.

tamate by significant levels. It can also pull flux through the TCA cycle and help reduce other C2 (ethanol and acetate) and C3 byproducts (alanine, pyruvate). sucAB and lpdA were cloned on pZS* plasmid under the pA promoter as described above. ALD and ADH required for BDO production were expressed on pPSX23R as described earlier.

Table 40 shows the 4HB and BDO production in 96-well plates from 4 replicates of strain 3933 after 24 hours of culture time. Host strain 3933 is based on strain ECKh-432 whose construction is described above and in US20110045575. Notable modifications include deletions in adhE, ldhA, pflB, mdh, and arcA. Strain ECKh-432 also contains chromosomally integrated copies of sucD from

TABLE 39

BDO, 4-hydroxybutyrate (4HB) and ethanol data for four 4HB-producing replicates that had the gene ppc overexpressed on pZS* after 24 hours of culture time in 96-well plates. The top 4 rows show the replicate data for the control cultures. All the concentrations are in mM.

| Host | Plasmid #1 | OD | 4HB | BDO | EtOH |
|------|------------|------|------|------|------|
| 3162 | pZS*135 | 3.08 | 5.16 | 23.3 | 2.11 |
| 3162 | pZS*135 | 2.96 | 5.23 | 24.5 | 2.27 |
| 3162 | pZS*135 | 2.76 | 4.98 | 25.2 | 2.23 |
| 3162 | pZS*135 | 3.05 | 6.02 | 26 | 2.3 |
| 3162 | pZS*135-(5k)525 | 3.02 | 9.18 | 29.9 | 1.59 |
| 3162 | pZS*135-(5k)525 | 2.50 | 9.32 | 28.8 | 1.47 |
| 3162 | pZS*135-(5k)525 | 3.24 | 9.3 | 28 | 1.49 |
| 3162 | pZS*135-(5k)525 | 3.38 | 24.5 | 0.72 | 0.69 |

Example XXXII

Overexpression of Alpha-ketoglutarate Dehydrogenase

This example describes overexpression of alpha-ketoglutarate dehydrogenase. See corresponding example in WO2013/186402.

This enzyme complex is formed by sucA, sucB and lpdA in *Escherichia coli*. It converts alpha-ketoglutarate into succinyl-CoA that is subsequently channeled into the BDO pathway. A limitation in this pathway, including any limitation in the capacity of alpha-ketoglutarate dehydrogenase, can lead to the formation of glutamate via, for example, glutamate dehydrogenase (gdhA). This leads to a carbon loss and reduction in yield. Expressing an extra copy of sucAB and lpdA in the BDO-producing strain helped reduce glu-

*Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). It contains deletions in the native alcohol dehydrogenase genes adhP, yqhD, yahK, and yjgB. The strain contains a chromosomally integrated copy of 4-hydroxybutyryl-CoA transferase expressed from the pA promoter at the attB locus. It also has deletions of cytochrome oxidases, cyoABCD and appBC, and adh is integrated on the chromosome under the promoter p119 at the hemN locus.

TABLE 40

BDO, 4HB and ethanol data for four 4HB producing replicates of strain 3933 that had the genes sucAB-lpdA overexpressed on a plasmid. The bottom 4 rows show the replicate data for the control cultures of the host strain 3933. All the concentrations are in mM and were measured after 24 hours of culture time in 96-well plates. 1438 refers to the native sucA gene (b0726), 1439 refers to the native wild type sucB gene (b0727), the last gene in the biobrick on pZS* is mutant version of lpdA (b0116) described previously in Example XIV This gene is a subunit of the pyruvate dehydrogenase complex in *Escherichia coli* and has been modified such that pyruvate dehydrogenase is not inhibited by NADH. The mutations were made as described in Vim et al., *Nature Chemical Biology* 7:445-452 (2011)).

| Host | plasmid_1 | OD | 4HB | BDO | Glutamate |
|------|-----------|------|------|-------|-----------|
| 3933 | pZS*13S_1438-1439-160D345K-lpdA-KP | 2.91 | 6.27 | 35.00 | 0.03 |
| 3933 | pZS*13S_1438-1439-160D345K-lpdA-KP | 2.89 | 6.37 | 33.50 | 0.03 |
| 3933 | pZS*13S_1438-1439-160D345K-lpdA-KP | 2.94 | 6.52 | 32.40 | 0.04 |
| 3933 | pZS*13S_1438-1439-160D345K-lpdA-KP | 2.96 | 5.76 | 31.10 | 0.04 |
| 3933 | pZS*13S | 3.06 | 6.44 | 38.30 | 2.68 |
| 3933 | pZS*13S | 3.05 | 5.42 | 36.40 | 2.20 |
| 3933 | pZS*13S | 3.22 | 5.36 | 36.40 | 2.21 |
| 3933 | pZS*13S | 3.12 | 4.95 | 35.00 | 2.08 |

Figure 73:
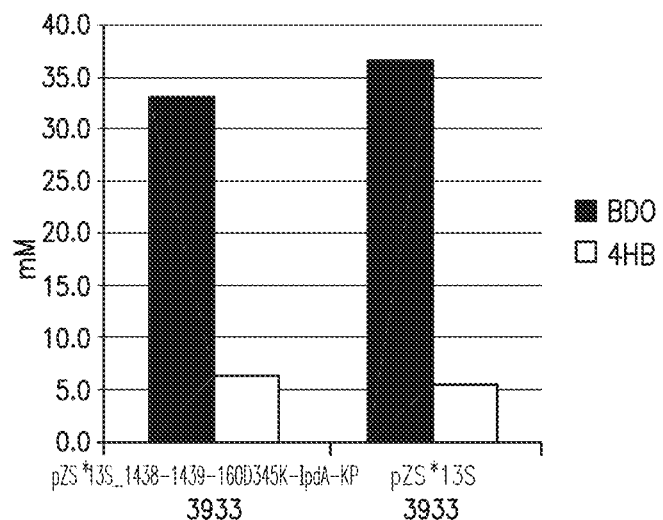
FIG. 73 shows the average BDO and 4HB numbers from four replicates of a 4HB producing host strain that had the genes sucAB and mutant lpdA overexpressed on pZS*compared with the corresponding averages from four replicates of the control strain. ALD and ADH were expressed on the plasmid pPZSX23R.
Figure 74:
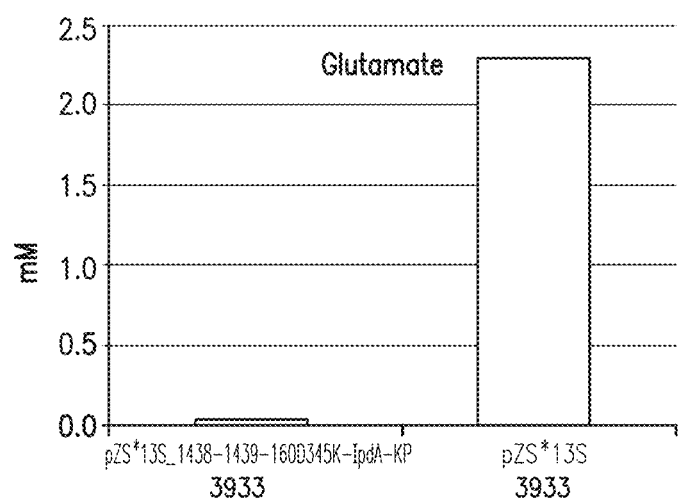
FIG. 74 shows the reduction in the average glutamate numbers from the four replicates of the strain that had the genes sucAB and mutant lpdA overexpressed on pZS* and compared with those from the control.

FIG. 73 shows the average BDO and 4HB numbers from four replicates of a 4HB producing host strain that had the genes sucAB and mutant lpdA overexpressed on pZS*compared with the corresponding averages from four replicates of the control strain. ALD and ADH were expressed on the plasmid pPZSX23R. FIG. 74 shows the reduction in the average glutamate numbers from the four replicates of the strain that had the genes sucAB and mutant lpdA overexpressed on pZS* and compared with those from the control. These results show that expression of sucAB resulted in a dramatic reduction in the amount of glutamate produced and did not adversely affect the production of BDO or 4HB.

Example XXXIII

Overexpression of a Non-Phosphotransferase Sugar Uptake System

This example describes overexpression of glucokinase, galP and or glf as representatives of a non-phosphotransferase (PTS) sugar uptake system. See corresponding example in WO2013/186402.

The primary mode of glucose uptake in the host strains is the PTS system. Every molecule of glucose converted into glucose-6-phosphate (G6P) via this system is accompanied by the conversion of one molecule of PEP into pyruvate. Note that PEP is converted into oxaloacetate via PEP carboxylase in the strains. Additionally, PEP is also converted into pyruvate (by the PTS system as well as pyruvate kinase) and subsequently into acetyl-CoA by pyruvate dehydrogenase in the strains. The BDO pathway requires equimolar amounts of oxaloacetate and acetyl-CoA for forming each mole of BDO. The fixed stoichiometry associated with the PTS system disturbs this balance, leading to higher ratios of acetyl-CoA relative to oxaloacetate. This then leads to production of ethanol and acetate in the cells. The overexpression of non-PTS mode of sugar uptake helps alleviate this issue and balance the amount of oxaloacetate available in comparison to acetyl-CoA, thus increasing flux through the BDO pathway, reducing the C2 byproducts, acetate and ethanol, and reducing the C3 byproducts, pyruvate and alanine.

The primary mechanism of non-PTS glucose uptake is via a permease such as galP to import the sugar and then its ATP-dependent phosphorylation via the kinase encoded by glk. An alternate way to uptake glucose is via the glucose facilitator, glf. While $E.\ coli$ does not have this facilitator, one was cloned from Zymomonas mobilis and introduced into $E.\ coli$ (Parker et al. Mol Microbiol. 15(5):795-802 (1995)).

Example XXXIV

Expression of Gamma-butyrolactone Esterase

This example describes expression of a gamma-butyrolactone esterase. See corresponding example in WO2013/186402.

Gamma-butyrolactone (GBL) is a byproduct formed during the fermentation of sugars to 1,4-butanediol (BDO). It is formed from the unstable pathway intermediate 4-hydroxybutyryl-CoA. To a small extent, it can also formed by spontaneous lactonization of 4-hydroxybutyrate.

Figure 75:
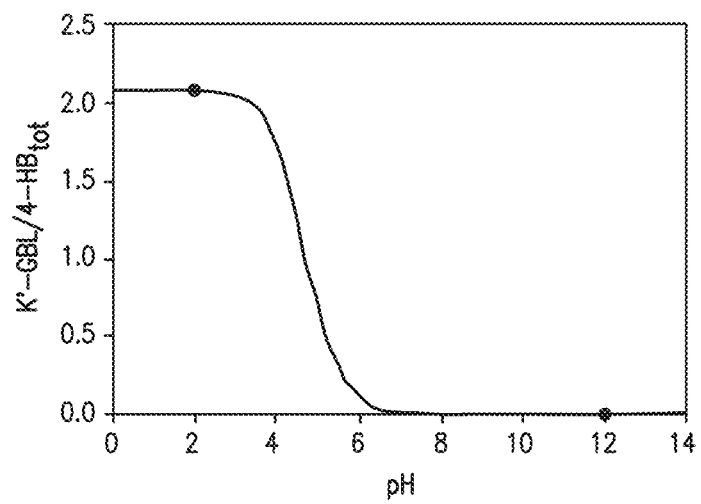
FIG. 75 shows apparent equilibrium constant for lactonization of 4-HB to GBL as a function of pH (at 22° C.) (from Efe et al., *Biotechnol. Bioeng.* 99:1392-1406 (2008)).

Hydroxyacids and their corresponding lactones exist in pH-dependent equilibrium with each other. Lactonization is acid-catalyzed and favorable at low pH. Under alkaline conditions the equilibrium is driven to the open-chain hydroxycarboxylate anion. At the cytoplasmic pH, typically 7.4, hydrolysis of the GBL lactone is favored (FIG. 75). The hydrolysis of GBL to 4-HB can be accelerated in the presence of an enzyme with GBL esterase activity, thus improving the yield and eliminating a byproduct that can complicate downstream separations of the product.

Esterases from Yersinia intermedia 29909 and Agrobacterium tumefaciens str. C58 (Carlier et al., Mol. Plant Microbe Interact. 17(9):951-957 (2004)) were identified and selected as exemplary esterase genes. The nucleotide sequence of the Yersinia gene (locus yinte0001_13710) is shown in FIG. 89 (see also GenBank ZP_04636075.1; GI: 238792441). The nucleotide sequence of the gene from Agrobacterium tumefaciens is shown in FIG. 90. The gene can also be designated ahlK. Additionally exemplary esterases include AttM of Escherichia coli KTE10 (GenBank ZP_19612688.1, GI: 432369596) and attM of Photorhabdus asymbiotica (GenBank YP_003039319.1 GI: 253987963).

Table 41 shows BDO, 4HB and GBL data from 96 well-plates of four replicates of a strain that had the esterase integrated (Strain 2387) and compared with the control with no esterase (strain 2237). Host strain 2237 is based on strain ECKh-432 whose construction is described above and in US20110045575. Notable modifications include deletions in adhE, ldhA, pflB, mdh, and arcA. Strain ECKh-432 also contains chromosomally integrated copies of sucD from Porphyromonas gingivalis (encoding CoA-dependant succinate semialdehyde dehydrogenase), sucA from Mycobacterium bovis (encoding alpha-ketoglutarate decarboxylase), 4hbd from P. gingivalis (encoding 4-hydroxy butyrate dehydrogenase), and 4hbd from Clostridium kluyveri (encoding 4-hydroxybutyrate dehydrogenase). Strain 2237 contains deletions in the native alcohol dehydrogenase genes adhP, yqhD, yahK, and yjgB. It also contains a chromosomally integrated copy of 4-hydroxybutyryl-CoA transferase expressed from the pA promoter at the attB locus. An additional deletion in poxB was also introduced.

TABLE 41

BDO, 4HB and GBL data from 96 well-plates of four replicates of a strain that had the esterase integrated (Strain 2387) and compared with the control with no esterase (strain 2237). All concentrations are in mM and were measured after 19 hours of culture time.

| Host | OD | 4HB | BDO | GBL |
|---|---|---|---|---|
| 2237 | 3.56 | 2.50 | 27.70 | 4.54 |
| 2237 | 3.43 | 2.54 | 32.20 | 5.00 |
| 2237 | 3.37 | 2.44 | 27.10 | 4.34 |
| 2237 | 3.54 | 2.19 | 22.60 | 3.26 |
| 2387 | 3.80 | 0.00 | 23.60 | 0.00 |
| 2387 | 3.87 | 2.59 | 24.70 | 0.65 |
| 2387 | 4.00 | 2.62 | 27.70 | 0.59 |
| 2387 | 4.30 | 3.20 | 29.00 | 0.68 |

Figure 76:
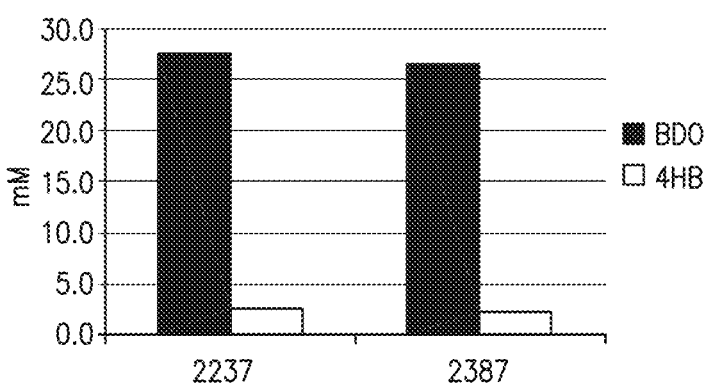
FIG. 76 shows the average BDO and 4HB numbers from four replicates of a host strain capable of producing 4-hydrobutyryl-CoA that had the esterase integrated (2387) compared with the corresponding averages from four replicates of the control strain (2237).

FIG. 76 shows the average BDO and 4HB numbers from four replicates of a host strain capable of producing 4-hydrobutyryl-CoA that had the esterase integrated (2387) compared with the corresponding averages from four replicates grated copy of 4-hydroxybutyryl-CoA transferase expressed from the p119 promoter at the attB locus. It also has deletions of cytochrome oxidases, cyoABCD and appBC. The adh was integrated on the chromosome under the promoter p119 at the hemN locus.

TABLE 42

BDO and 4HB data from 96 well-plates of four replicates of a 4-HB producing strain that had the sucCD genes deleted (Strain 4269) compared with the no deletion control (strain 4070). Higher 4HB was observed with strains that had the sucCD deleted. All concentrations are in mM and were measured after 24 hours of culture time.

| Host | OD | 4HB | BDO |
|---|---|---|---|
| 4070 | 3.62 | 0.289 | 37.2 |
| 4070 | 3.58 | 0.777 | 41.4 |
| 4070 | 3.33 | 0.377 | 28.5 |
| 4070 | 3.75 | 0.792 | 54.4 |
| 4269 | 2.95 | 8.93 | 50.5 |
| 4269 | 2.68 | 8.07 | 50.5 |
| 4269 | 3.34 | 8.65 | 50.1 |
| 4269 | 2.94 | 8.55 | 51.8 |

Figure 77:
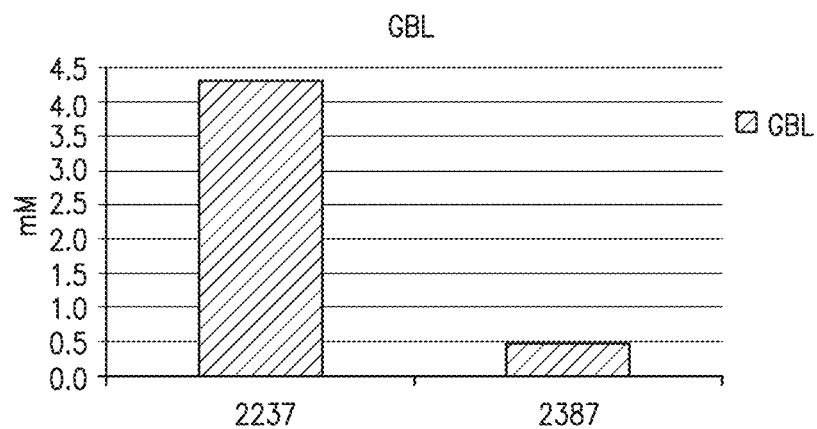
FIG. 77 shows the average GBL numbers from four replicates of a host strain that had the esterase integrated (2387) compared with the corresponding averages from four replicates of the control strain (2237). Lower GBL was observed with the strains that had the esterase integrated.

| Host | plasmid_1 | OD | 4HB | BDO |
|---|---|---|---|---|
| 4070 | pZS*13S-p100-ALD | 3.62 | 0.289 | 37.2 |
| 4070 | pZS*3S-p100-ALD | 3.58 | 0.777 | 41.4 |
| 4070 | pZS*13S-p100-ALD | 3.33 | 0.377 | 28.5 |
| 4070 | pZS*13S-p100-ALD | 3.75 | 0.792 | 54.4 |
| 4269 | pZS*13S-p100-ALD | 2.95 | 8.93 | 50.5 |
| 4269 | pZS*13S-p100-ALD | 2.68 | 8.07 | 50.5 |
| 4269 | pZS*13S-p100-ALD | 3.34 | 8.65 | 50.1 |
| 4269 | pZS*13S-p100-ALD | 2.94 | 8.55 | 51.8 | of the control strain (2237). FIG. 77 shows the average GBL numbers from four replicates of a host strain that had the esterase integrated (2387) compared with the corresponding averages from four replicates of the control strain (2237). Lower GBL was observed with the strains that had the esterase integrated. These results demonstrate expression of an enzyme having gamma-butyrolactone esterase activity without adversely affecting production of BDO or 4HB.

Example XXXV

Deletion of Succinyl-CoA Synthetase

This example describes deletion of succinyl-CoA synthetase. See corresponding example in WO2013/186402.

Succinyl-CoA synthetase is encoded by sucCD in Escherichia coli. The deletion of arcA highly upregulates the expression of these genes (and the entire sdh-suc operon) in the cells. Repeated rounds of flux through the TCA cycle leads to carbon loss as $CO_2$. The deletion of sucCD blocked the TCA cycle downstream of succinyl-CoA, reducing the $CO_2$ losses by ~70% and leading to a corresponding increase in BDO titers and yields.

Figure 78:
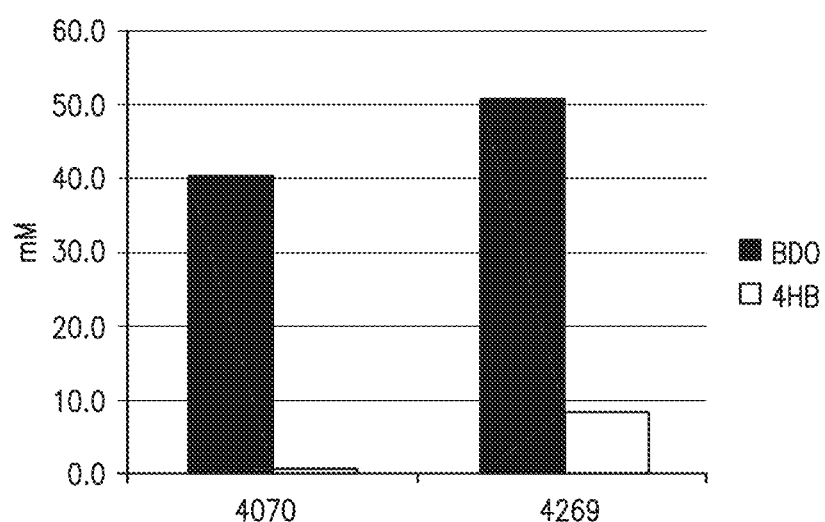
FIG. 78 shows the average BDO and 4HB numbers from four replicates of a host strain that had the genes sucCD deleted (4269) compared with the corresponding averages from four replicates of the control strain (4070).

The deletion of sucCD was introduced in host strain 4070. This strain is based on strain ECKh-432 whose construction is described above and in US20110045575. Notable modifications include deletions in adhE, ldhA, pflB, mdh, and arcA. Strain ECKh-432 also contains chromosomally integrated copies of sucD from Porphyromonas gingivalis (encoding CoA-dependant succinate semialdehyde dehydrogenase), sucA from Mycobacterium bovis (encoding alpha-ketoglutarate decarboxylase), 4hbd from P. gingivalis (encoding 4-hydroxybutyrate dehydrogenase), and 4hbd from Clostridium kluyveri (encoding 4-hydroxybutyrate dehydrogenase). Strain 4070 contains deletions in the native alcohol dehydrogenase genes adhP, yqhD, yahK, and yjgB. Additionally, this strain contains a chromosomally inte- FIG. 78 shows the average BDO and 4HB numbers from four replicates of a host strain that had the genes sucCD deleted (4269) compared with the corresponding averages from four replicates of the control strain (4070). These results demonstrate increased yield of BDO and 4HB with the deletion of sucCD.

Example XXXVI

Deletion of Acyl Coenzyme A Thioesterases

This example describes deletion of acyl coenzymeA thioesterases ybgC and tesB. See corresponding example in WO2013/186402.

One of the intermediates in the BDO pathway is 4-hydroxybutyryl-CoA. This compound can spontaneously or enzymatically get cyclized to form GBL (gamma-butyryllactone). E. coli possesses some reversible CoA thioesterases reported to have broad substrate specificity on CoA substrates of C4 to C6 groups. The deletion of these gene candidates eliminated approximately 50% of the GBL formation via the pathway. Such activities can be found analogously in other organisms.

The deletions of tesB and ybgC were made in host strain 1136. This strain is based on strain ECKh-432 whose construction is described above and in US20110045575. Notable modifications include deletions in adhE, ldhA, pflB, mdh, and arcA. Strain ECKh-432 also contains chromosomally integrated copies of sucD from Porphyromonas gingivalis (encoding CoA-dependant succinate semialdehyde dehydrogenase), sucA from Mycobacterium bovis (encoding alpha-ketoglutarate decarboxylase), 4hbd from P. gingivalis (encoding 4-hydroxybutyrate dehydrogenase), and 4hbd from Clostridium kluyveri (encoding 4-hydroxybutyrate dehydrogenase). Strain 1136 has additional deletions in ndh (NADH dehydrogenase II) and succinate semi aldehyde dehydrogenase encoding genes, sad and gabD.

TABLE 43

OD, BDO, 4HB and GBL numbers of four replicates of a strain capable of producing 4-hydroxybutyryl-CoA that had both tesB and ybgC deleted (1197) and compared with the control with neither of these deletions (Host 1136). All concentrations are in mM and were measured after 40 hours of culture time in 20 mL bottles.

| Host | OD | BDO | 4HB | GBL |
|---|---|---|---|---|
| 1136 | 2.428 | 26.2 | 3.1 | 1.8 |
|  | 2.344 | 27.4 | 2.7 | 1.7 |
|  | 2.392 | 26.6 | 3.3 | 1.8 |
| 1197 | 3.324 | 29.9 | 2.8 | 1.0 |
|  | 2.712 | 29.1 | 2.6 | 0.9 |
|  | 2.924 | 32.0 | 2.9 | 0.9 |

Figure 79:
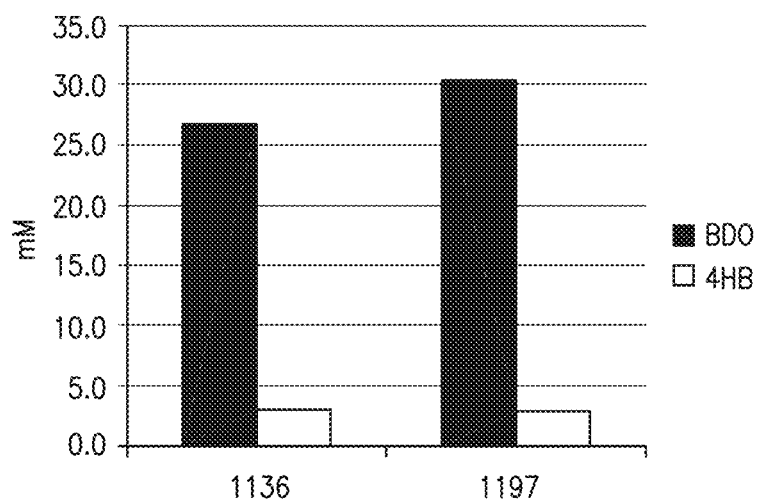
FIG. 79 shows the average BDO and 4HB numbers from three replicates of a host strain that had the genes ybgC and tesB deleted (1197) compared with the corresponding averages from three replicates of the control strain (1136).
Figure 80:
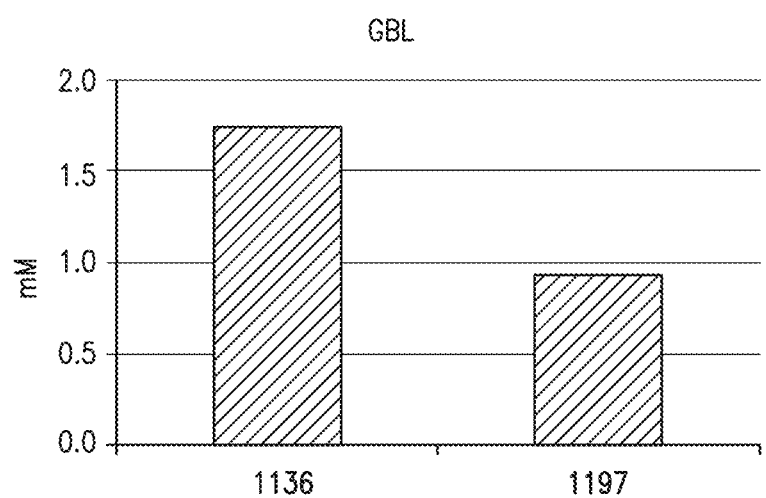
FIG. 80 shows the average GBL numbers from three replicates of a host strain that had the genes ybgC and tesB deleted (1197) compared with the corresponding averages from three replicates of the control strain (1136).

FIG. 79 shows the average BDO and 4HB numbers from three replicates of a host strain that had the genes ybgC and tesB deleted (1197) compared with the corresponding averages from three replicates of the control strain (1136). FIG. 80 shows the average GBL numbers from three replicates of a host strain that had the genes ybgC and tesB deleted (1197) compared with the corresponding averages from three replicates of the control strain (1136). These results demonstrate that deletion of one or more acyl coenzyme A thioesterases decreased production of gamma-butyrolactone, increased production of BDO and had no adverse affect on production of 4HB.

Example XXXVII

Deletions to Prevent or Reduce Backflux into the Pathway

This example describes deletions to prevent backflux into the pathway. See corresponding example in WO2013/186402.

At high titers of 1,4-butanediol (BDO) in the culture, it starts to get reimported into the cells. Once inside the cells, it is metabolized through the TCA cycle. To prevent this backflux of BDO into the cells, alcohol dehydrogenases that were identified as candidates for the reverse flux were deleted. The candidates were identified by two approaches, first, all the alcohol dehydrogenases were listed and prioritized based on their substrate specificity. Microarrays were conducted to determine how high each one of them was expressed. Based on this, a short list of 5 candidates was generated from a list of approximately 35 adh candidates. Secondly, protein fractions with endogenous backflux activity (NADP+dependent BDO conversion to 4-hydroxybutyraldehyde) were isolated from strain 1427 (alcohol dehydrogenase encoded by yqhD removed and no downstream pathway present, cells accumulate 4HB but do not make BDO) grown microaerobically in MM9 media. The sample was purified while following the backflux activity. The strategy employed is outlined below Based on early experiments, the endogenous ADH activity was found to be primarily NADPH dependent and salted out in high (>35%) ammonium sulfate. Afresh sample of 1427 cells from a 2 L LB preparation grown aerobically overnight was lysed using the microfluidizer at 15,000 psi. The sample was then fractionated via ammonium sulfate. The 35% pellet contained little ADH activity and was not processed further, while the 60% pellet contained active ADH with significant backflux activity and was moved onto further purification.

Figure 81:
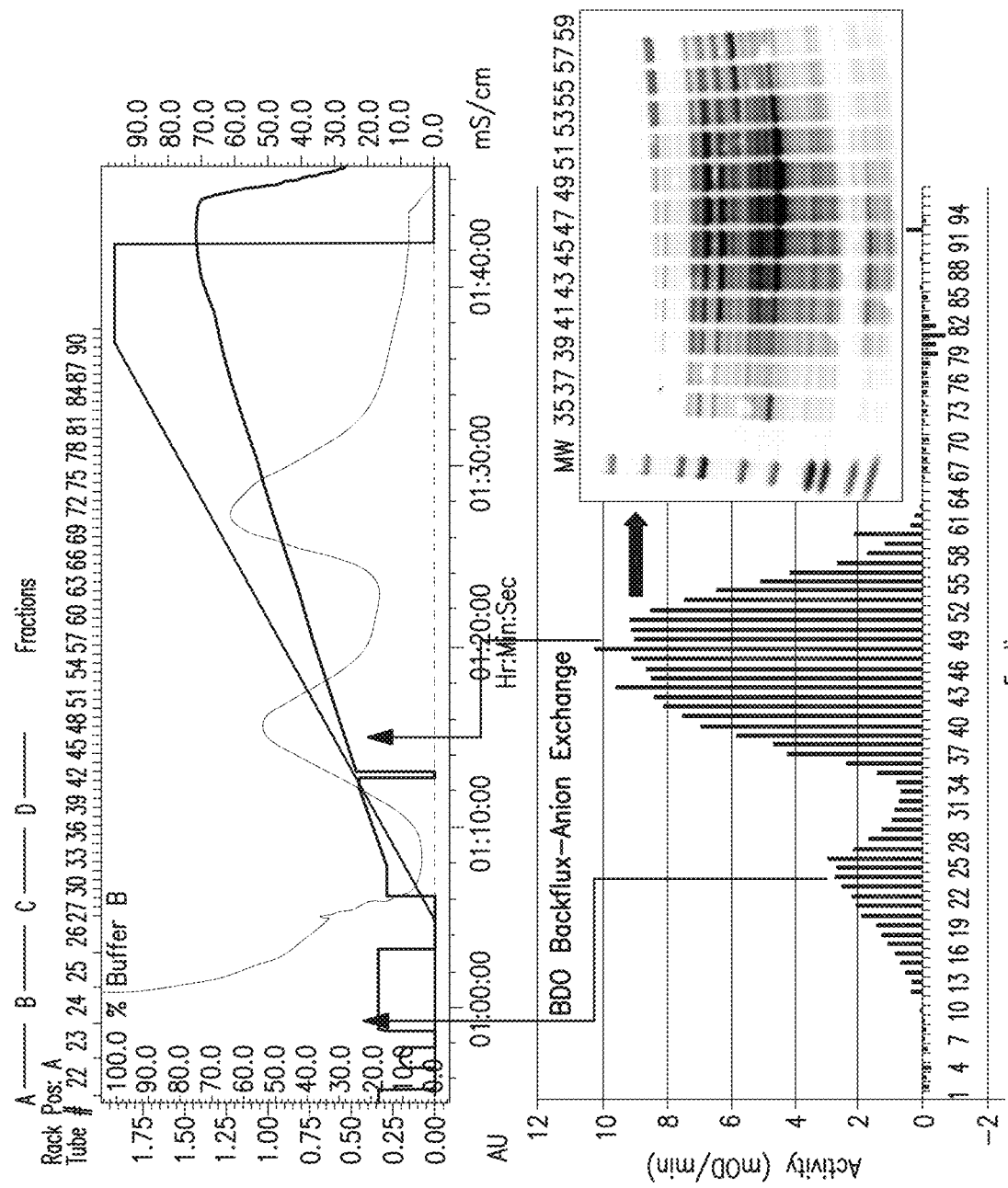
FIG. 81 shows the profile for the anion exchange elution, backflux activity, as well as the SDS page for the fractions.

Anion Exchange Purification. The 60% ammonium sulfate pellet was resuspended in a low salt buffer and dialyzed overnight to remove the residual ammonium sulfate. The sample was loaded onto a 5 ml Q-sepharose column (strong anion exchange) and eluted via a slow increasing salt gradient. The profile for the anion exchange elution, backflux activity, as well as the SDS page for the fractions is shown below in FIG. 81.

The first large peak shown on the left is off-scale and corresponds to proteins that did not bind the column. The peak had low backflux activity. The next peak shown in the middle of the chromatogram had significant backflux activity. An SDS-PAGE of this peak was run and indicates that further purification is needed in order to isolate the protein of interest.

Figure 82:
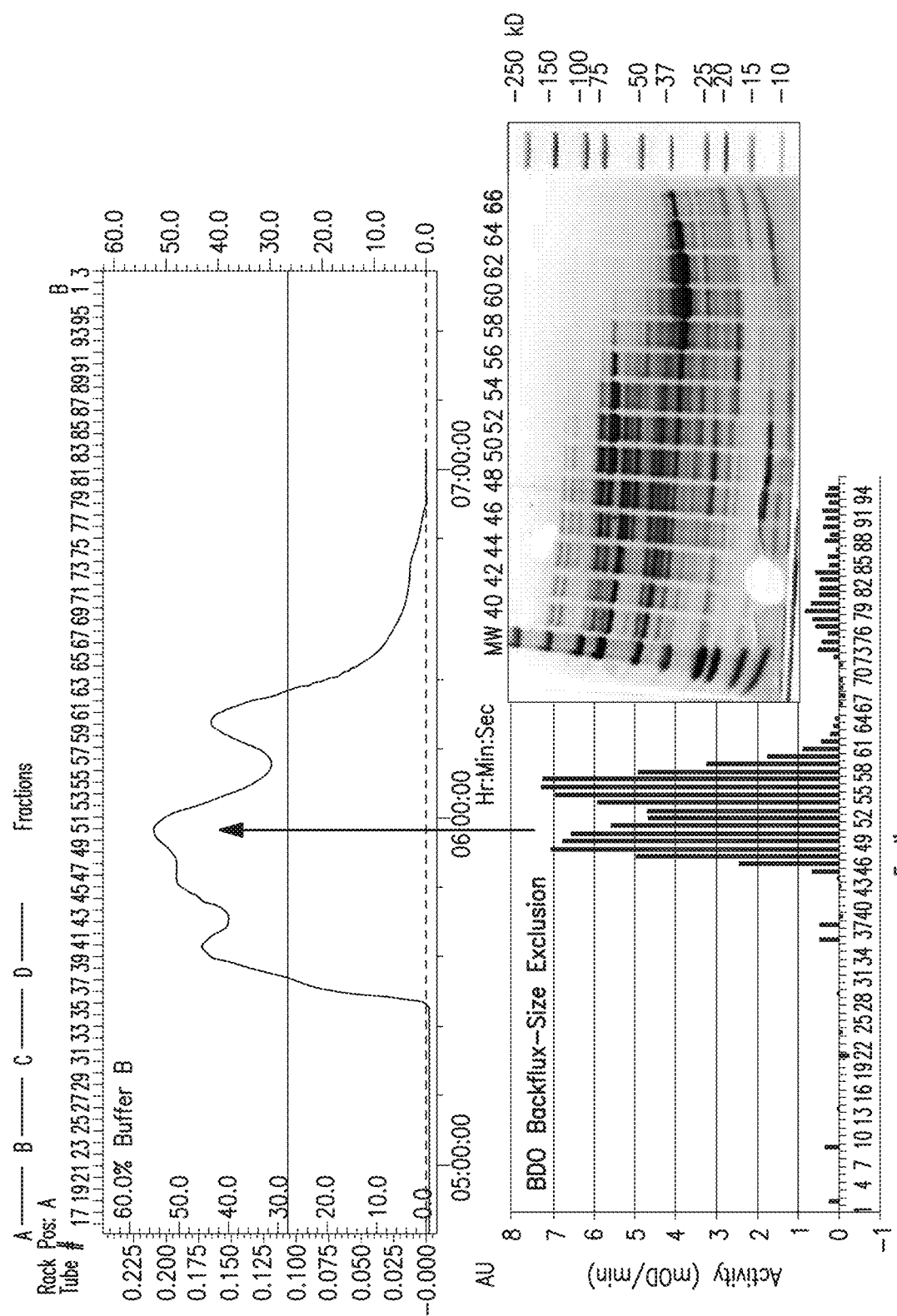
FIG. 82 shows the profile from the size exclusion chromatogrpahy, the backflux activity, as well as the SDS page for the fractions.

Size Exclusion Chromatography. The peak backflux activity from anion exchange was pooled and concentrated to allow for application to a S200 sephacryl size exclusion column. The column successfully removed impurities from the sample and the results are shown below (FIG. 82).

The results of the sizing column indicated that the protein of interest behaved as a mid-range MW protein, ~50 kDa. However, it was not clear what the identity of the protein was, but it narrowed down to approximately 20 bands on the gel. Additional chromatography was performed to attempt to clean up the sample prior to mass spec analysis.

Figure 83:
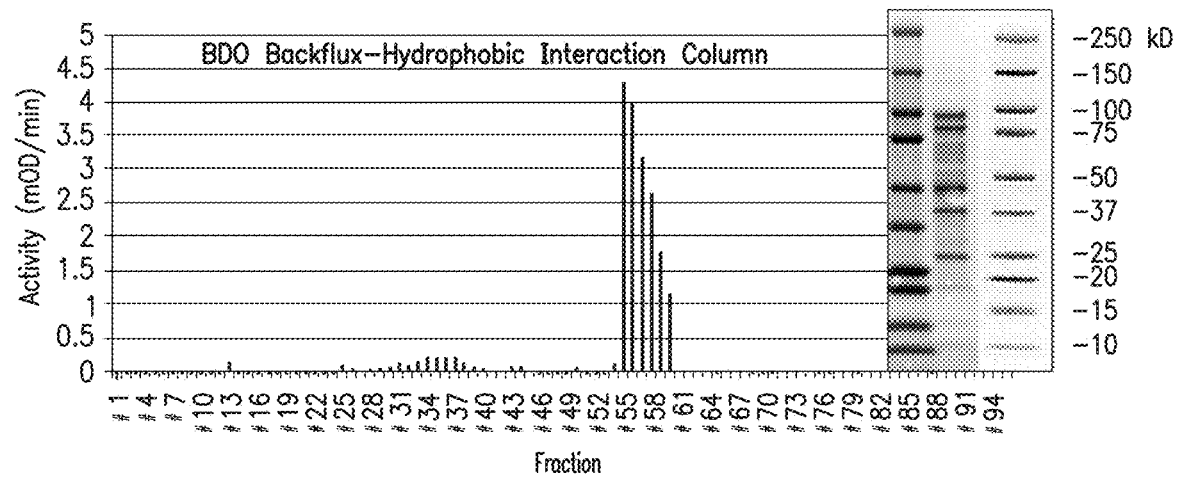
FIG. 83 shows backflux activity from the size exclusion column and the SDS page.

Hydrophobic Interaction Chromatography. The peak with the highest backflux activity from the size exclusion column was pooled and loaded on a phenyl sepharose column (hydrophobic interaction column). The ionic strength of the sample was increased to facilitate binding to the resin. The results are shown below (FIG. 83).

The sample shown on the SDS-PAGE was analyzed by mass spectrometry in order to identify the protein(s) that is responsible for the backflux. From the gel there are 5 prominent bands alongside a small handful of background proteins (~5).

The purified sample was analyzed by mass spectrometry analysis, and a list of 30 proteins was obtained. From this list the gene selected was:

| Accession | Name | Gene |
|---|---|---|
| gi\|170083708 | Zn-dependent/NAD(P)-binding alcohol dehydrogenase | yjgB |

Figure 84:
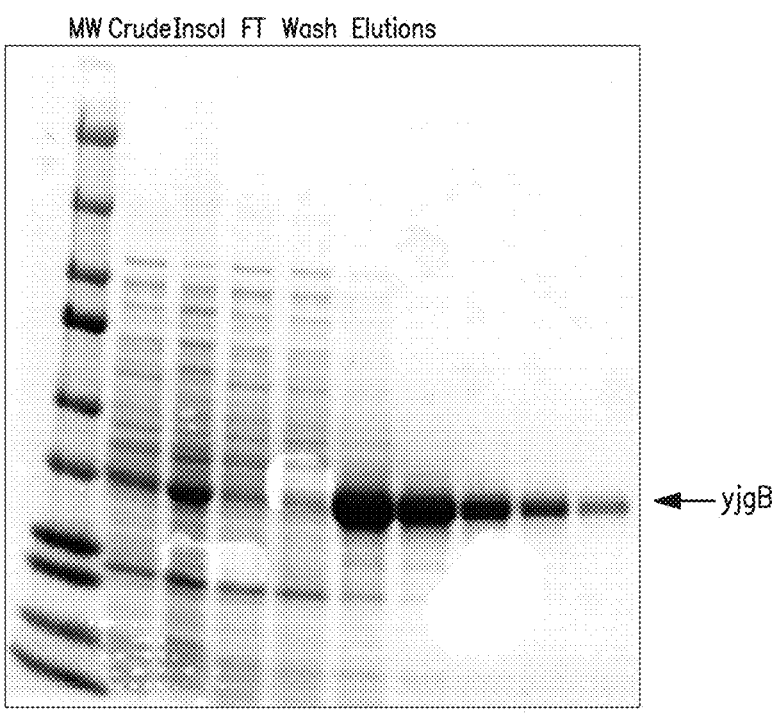
FIG. 84 shows the yjgB gene was cloned with a streptavidin tag expressed and purified in order to characterize its properties. The results of the purification are via SDS-PAGE.
Figure 85:
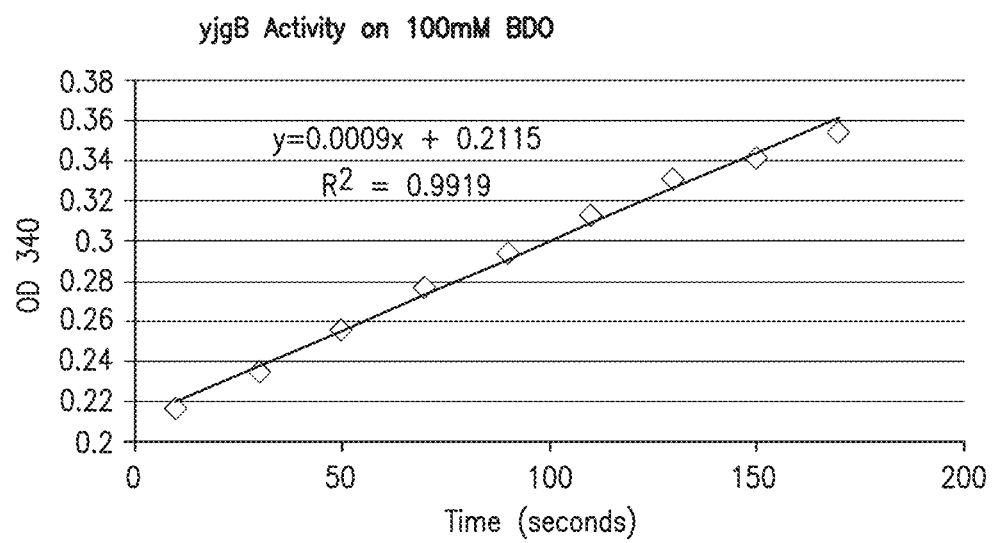
FIG. 85 shows yjgB activity in 100 mM BDO.

The yjgB gene was cloned with a streptavidin tag, expressed and purified in order to characterize its properties. The results of the purification, as analyzed by SDS-PAGE, are shown in FIG. 84. The protein expressed well, and acceptable yields of purified protein were obtained. Initial characterization with BDO as a substrate was performed in the presence of NADP+ and robust activity was confirmed (see FIG. 85).

On the basis of the protein fractionation and the microarray results, four genes were selected and deleted on top of each other to obtain strain 1889 from 1872. The genes were yqhD (b3011; GenBank NP_417484.1, GI:16130909), yjgB (b4269; GenBank NP_418690.4, GI:90111716), yahK (b0325; GenBank NP_414859.1, GI:16128310) and adhP (b1478; GenBank NP_415995.4, GI:90111280).

The deletions of these four alcohol dehydrogenases were introduced in strain 1872. This strain is based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). Strain 1872 contains a chromosomally integrated copy of 4-hydroxybutyryl-CoA transferase expressed from the pA promoter at the attB locus.

TABLE 44

OD, BDO, 4HB and GBL numbers of four replicates of a strain that had all four alcohol dehydrogenases identified for carrying backflux deleted (1889) compared with the control with neither of these deletions (Host 1872). The gene cat2 for 4HB conversion into 4-hydroxybutyryl-CoA was expressed on F' whereas ALD and ADH were expressed on pZS*-13S as described already. All concentrations are in mM and were measured after 24 hours of culture time in 96 well-plates.

| Host | OD   | 4HB | BDO  | GBL  |
|------|------|-----|------|------|
| 1872 | 4.61 | 3.3 | 60.8 | 12.5 |
| 1872 | 6.09 | 3.6 | 90.2 | 15.3 |
| 1872 | 5.88 | 3.1 | 84.4 | 17.3 |
| 1872 | 5.84 | 2.9 | 96.3 | 15.9 |
| 1889 | 5.94 | 3.6 | 92.6 | 14.0 |
| 1889 | 6.59 | 3.3 | 88.9 | 13.1 |
| 1889 | 6.59 | 3.3 | 82.4 | 13.4 |
| 1889 | 6.58 | 3.6 | 89.4 | 14.4 |

Figure 86:
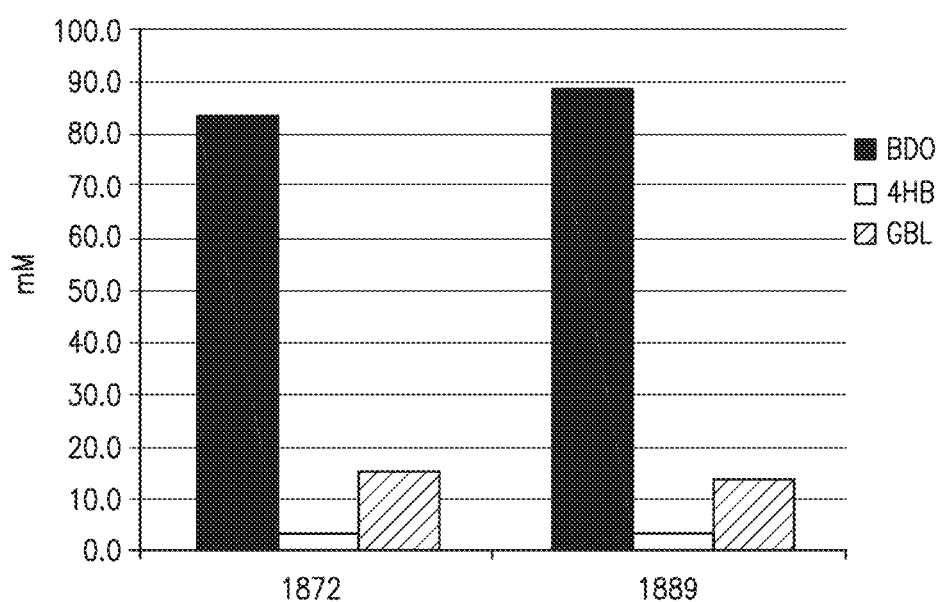
FIG. 86 shows the average BDO, 4HB and GBL numbers for the strain 1872 versus strain 1889.

FIG. 86 shows the average BDO, 4HB and GBL numbers for the strain 1872 versus strain 1889. These results demonstrate that metabolic modifications that decrease backflux result in an increased yield of BDO and no adverse affect on production of 4HB.

Example XXXVIII

Deletions to Improve the Energetic Efficiency of Oxidative Phosphorylation

This example describes deletions to improve the energetic efficiency of oxidative phosphorylation. See corresponding example in WO2013/186402.

The electron transport chain of *Escherichia coli* has multiple NADH dehydrogenases and cytochrome oxidases, with varying ability to translocate protons. For example, NADH dehydrogenase II in *E. coli* is an NADH consuming system that is not linked with proton translocation (H+/2e−=0) whereas NADH dehydrogenase I encoded by nuo is reported to translocate 4 protons per pair of electrons. The major role of Ndh-II is to oxidize NADH and to feed electrons into the respiratory chain (Yun et al., *J Appl. Microbiol.* 99:1404-1412 (2005)). The affinity of NdhII for NADH is relatively low (Hayashi et al., *Biochim. Biophys. Acta* 977:62-69 (1989)). It has been suggested that NdhII may operate to regulate the NADH pool independently of energy generation and is likely to be important when the capacity of bacteria to generate energy exceeds demand. The ndh gene has been shown to be repressed by the fnr gene product in such a way that the expression is optimal under conditions of high oxygen concentrations. The deletion of ndh would thus help in improving the energy efficiency of the cell. Similarly, there are several other NADH dehydrogenases that are not known to translocate any protons and thus do not help in ATP production, for example, wrbA, yieF, and kefF in *E. coli*. Homologues of these can be found in other organisms and eliminated to improve the ATP production for every unit of oxygen consumed.

Host strain 879 (the parent strain for ndh deletion) was based on strain ECKh-432 whose construction is described above and in US20110045575. Notable modifications include deletions in adhE, ldhA, pflB, mdh, and arcA. Strain ECKh-432 also contains chromosomally integrated copies of sucD from *Porphyromonas gingivalis* (encoding CoA-dependant succinate semialdehyde dehydrogenase), sucA from *Mycobacterium bovis* (encoding alpha-ketoglutarate decarboxylase), 4hbd from *P. gingivalis* (encoding 4-hydroxybutyrate dehydrogenase), and 4hbd from *Clostridium kluyveri* (encoding 4-hydroxybutyrate dehydrogenase). Strain 879 also has deletions of the succinate semialdehyde dehydrogenase genes, sad and gabD.

TABLE 45

The BDO, 4HB and GBL production in three replicates of the strain that had ndh deleted compared with the replicates of the host strain (879) with ndh intact. The experiments were conducted in 20 mL bottles as described in the protocol. The ALD and ADH were present on the plasmid pZS* to allow the conversion of 4-HB CoA to 4-HB aldehyde and subsequently to BDO. All concentrations are in mM and were measured after 24 hours of culture time.

| Host | OD   | BDO  | GBL  | 4HB  |
|------|------|------|------|------|
| 879  | 1.61 | 3.27 | 0.83 | 1.28 |
| 879  | 2.45 | 4.15 | 0.99 | 1.14 |
| 956  | 2.31 | 4.48 | 0.63 | 1.01 |
| 956  | 2.01 | 4.31 | 0.59 | 0.96 |
| 956  | 2.54 | 4.92 | 0.59 | 1.00 |

Figure 87:
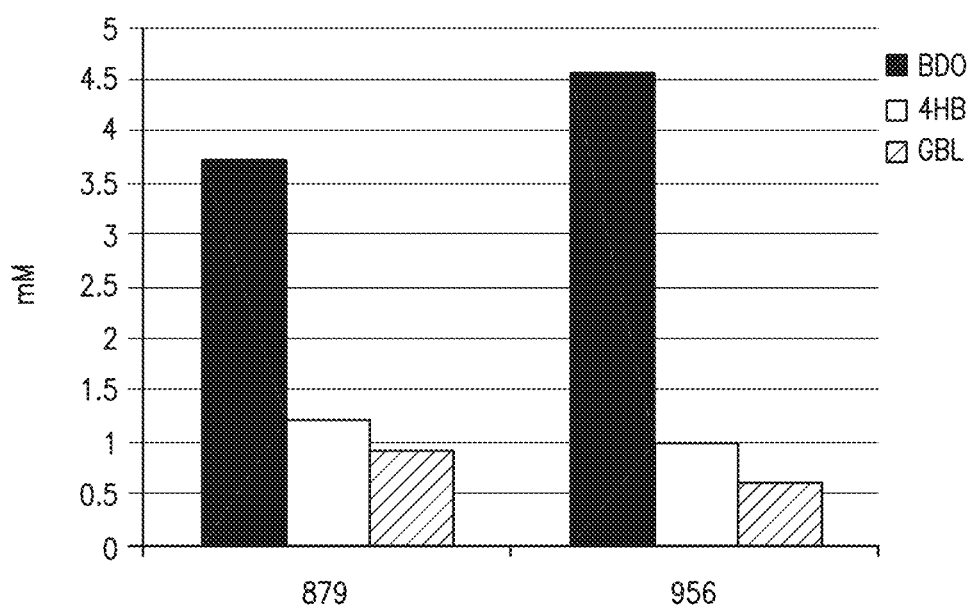
FIG. 87 shows the average BDO, 4HB and GBL numbers for the strain 956 versus strain 879.

FIG. 87 shows the average BDO, 4HB and GBL numbers for the strain 956 versus strain 879. These results demonstrate that deletions that improve the energy efficiency of oxidative phosphorylation increase the yield of BDO and have no adverse affect on 4HB production.

Example XXXIX

Deletion of Cytochrome Oxidases

This example describes deletion of cytochrome oxidases. See corresponding example in WO2013/186402.

On the electron output side of the electron transport chain, multiple cytochrome oxidases are present that have different energy-conserving efficiencies. The cytochrome bo complex, encoded by the cyo operon, actively pumps electrons over the membrane and results in an H+/2e− stoichiometry of 4. The cytochrome bd-I complex does not actively pump protons, but due to the oxidation of the quinol on the periplasmic side of the membrane and subsequent uptake of protons from the cytoplasmic side of the membrane, which are used in the formation of water, the net electron transfer results in a H+/2e-stoichiometry of 2. This is encoded by the cyd operon. Until recently, the proton translocation stoichiometry of cytochrome bd-II oxidase, encoded by appBC, was not known, but it has now been established that this oxidase is electrogenic (Borisov et. al., *Proc. Natl. Acad Sci. USA* 108:17320-17324 (2011)). These genes are normally induced upon entry into stationary phase or under conditions of carbon and phosphate starvation (Atlung et al., *J. Bacteriol.* 179:2141-2146 (1997)).

Properties and Abundance of the Cytochrome Oxidases: The cyd operon is regulated in an oxygen-dependent manner by fnr and arcA and the expression is optimal under microaerophilic conditions (Calhoun et al., *J. Bacteriol.* 175:3020-3025 (1993)). The bo-type oxidase predominates when *E. coli* is grown at high oxygen tension. The cyo operon is also regulated by both arcA and fnr. A literature study indicates that in aerobically grown cells the cytochrome o oxidase is present at a level of approximately 304 molecules per cell and the cytochrome d oxidase at 204 molecules per cell (Minohara et al., *J. Biosci. Bioengineer* 93(5):464-469 (2002)). Under anaerobic conditions, cytochrome d oxidase is predominant and is present at about 606 molecules per cell in contrast to only 2 molecules per cell of cytochrome o oxidase. The Km for $O_2$ of cytochrome bd oxidase is much lower than that of the cytochrome bo oxidase (Minohara et al, supra, 2002). The former has a Km of 10 nM, and cytochrome bo oxidase has a Km of ~1 µM.

ferent components of the electron transport chain between dilution rates of 0.1 and 0.7/hr (Calhoun et al., supra, 1993). Strains that were constrained to use the bd-type oxidase had increased oxygen consumption rates as compared to those that used only the cytochrome bo oxidase by a factor of 1.45-1.13. The ratio of the oxygen consumption rates for a strain that had both ndh and cyo deleted as compared to the strain with only ndh deleted was between 1.46 and 1.39. The authors of Calhoun et al., supra, 1993, concluded that the bd-type oxidase is less efficient than the bo-type oxidase but is still coupled.

In yet another study, it has been reported that *E. coli* wild-type cells containing both cytochrome bo and bd type terminal oxidases, pumped protons with a H+/O ratio of 4.5-4.9, but mutants with cytochrome bo oxidase deleted, showed ratios of 3.5-4.1 and the mutants with cytochrome bd oxidase showed a ratio of 4.8-5.6 (Minohara et al., supra, 2002). Mutants which lacked both cyo and cyd operon could not grow under aerobic conditions, but those that overexpressed cytochrome bo oxidase and those that overexpressed cytochrome bd oxidase grew as well as the parental W3110 strains. The cell yield of each of these strains was in proportion to their H+/O ratios. Interestingly, the strain which had cydAB deleted showed very poor cell yield initially. The cell yields were, however, improved dramati-

TABLE 46

Enzymatic characteristics of the cytochrome-bd oxidases from *E. coli* (from Bekker et al., *J. Bacteriol.* 191: 5510-5517 (2009))).

| Cytochrome | $V_{max}$ (mol O/mol cytochrome bd/s) | $K_m$ ($O_2$) at pH 7 (µM) | $K_m$ (UQ-$H_2$) at pH 7 (µM) | Cellular content (nmol/g protein) | In vivo sp act (mol $O_2$/mol cytochrome bd/s) |
|---|---|---|---|---|---|
| Cytochrome bd-I | 218 ± 20 | 0.3 | 85 ± 5 | 90 ± 29 | 58 ± 11 |
| Cytochrome bd-II | 818 ± 75 | 2.0 ± 0.3 | 250 ± 45 | 91 ± 32 | 70 ± 12 |
| Cytochrome bo | 225 | 6.0 | 47 | ND | ND |

In a study attempting to determine the P/O ratios in aerobically-grown *E. coli* (Noguchi et al., *J. Biochem.* 136:509-515 (2004)), it was determined that NDH-1 formed the predominant NADH dehydrogenase under both standard feed and limiting feed of glucose. However, cytochrome bd oxidase was found to be present in higher concentrations than cytochrome bo oxidase. The following table illustrates their findings on various NADH dehydrogenases and cytochrome oxidases.

cally once the cytochrome bo oxidase was overexpressed. The authors Minohara et al., supra, 2002) had hypothesized that the lower cell yields in the cyd mutant strain may be caused by the high H+ permeability of the membrane in the cyd mutant. They believed that the amounts of cytochrome bo in the mutant cells lacking the high-affinity oxygen-reducing cytochrome bd may not be sufficient to reduce the oxygen molecules at a low concentration, and thus the cell membranes were injured by reactive oxygen species and

TABLE 47

Concentrations of NADH dehydrogenases and cytochrome oxidase under aerobic growth conditions with different glucose feeding strategies (from Noguchi et al., supra, 2004)

| Conditions (Phase) | NDH-1 | NDH-2 (µmol/s/mg of protein) | bo-type | bd-type | NDH-1/ Total (%) | bo-type/ Total(%) |
|---|---|---|---|---|---|---|
| Standard glucose | | | | | | |
| (exponential: 3 h) | 1.58 ± 0.07 | 1.11 ± 0.06 | 1.38 ± 0.12 | 1.01 ± 0.10 | 58.8 ± 2.4 | 57.9 ± 4.5 |
| (exponential: 5 h) | 1.35 ± 0.03 | 0.86 ± 0.08 | 0.70 ± 0.05 | 1.07 ± 0.04 | 61.0 ± 1.4 | 39.6 ± 2.6 |
| (early stationary: 8 h) | 1.17 ± 0.01 | 0.88 ± 0.01 | 0.46 ± 0.08 | 0.98 ± 0.02 | 57.1 ± 0.5 | 32.0 ± 1.9 |
| Limited glucose | | | | | | |
| (early stationary) | 0.97 ± 0.05 | 0.70 ± 0.03 | 0.42 ± 0.04 | 0.75 ± 0.05 | 58.1 ± 2.29 | 36.0 ± 3.7 |

Effects of Deleting Cytochrome Oxidases: A chemostat study has been reported for understanding the ratios of specific oxygen consumption rates for strains lacking difwere made partially permeable. This cell stress could be relieved by overexpressing cytochrome bo oxidase (Minohara et al., supra, 2002).

TABLE 48

Properties of various E. coli mutants grown in a glucose-limited chemostat culture at a dilution rate of 0.15/hr. The cytochrome shown in parentheses is the active cytochrome oxidase. Each of these strains also had nuo deleted (from Bekker et al., supra, 2009).

| Mutant | $q_{O2}$ {mmol (g [dry wt])$^{-1}$ h$^{-1}$} | $q_{glucose}$ {mmol (g [dry wt])$^{-1}$ h$^{-1}$} | $Y_{glucose}$ (g [dry wt]) (g Glc)$^{-1}$ | $q_{acetate}$ {mmol (g [dry wt])$^{-1}$ h$^{-1}$} | $q_{ATP}$ {mmol (g [dry wt])$^{-1}$ h$^{-1}$} | H$^+$/2e$^-$ |
|---|---|---|---|---|---|---|
| MB30 (cytochrome bd-I) | 8.8 ± 1.3 | 3.2 | 0.26 | 1.5 ± 0.5 | 16.3 ± 2.2 | 2 |
| MB37 (cytochrome bd-II) | 11.1 ± 0.6 | 6.0 | 0.14 | 5.7 ± 0.7 | 16.6 | 0.2 ± 0.1 |
| MB34 (cytochrome bo) | 6.4 ± 0.4 | 2.3 | 0.36 | 0.4 ± 0.4 | 17.6 ± 0.4 | 4 |

A recent paper (Bekker et al., *J. Bacteriol.* 191:5510-5517 (2009)) investigated the effects of deleting cytochrome bd-II oxidase. The phenotype of the mutant strain lacking the cytochrome bd-II oxidase included a smaller ubiquinone pool when grown under glucose-excess conditions. This strain also had a decreased oxygen flux in glucose-limited chemostat conditions. These results suggested that cytochrome bd-II oxidase contributed significantly to the overall respiratory electron flux. Wild type *E. coli* MG1655 cells had a specific respiration rate that was approximately 46% higher than that of the mutant strain that lacked appBC (8.7 vs. 5.9 mmol/gDCW.hr). These were measured in glucose-limited chemostats at a dilution rate of 0.2/hr. In order to improve the energetic efficiency of the cells, the appBC was knocked out in the strains (Host strain 2424), and additionally cyoABCD was knocked out (Strain 2471). The table below shows the data for production of the C4 metabolites in 96 well plates with each of these strains. An additional advantage of deleting the two cytochrome oxidases (encoded by appBC and cyoABCD) and ndh is that it makes the cells relatively robust to a range of oxygen transfer rates in bigger fermenters. Since cydAB has a fixed stoichiometry for proton translacoation and so does nuo (NADH dehydrogenase I), the P/O ratio is rather constant and so is the biomass rate in different parts of a fermenter.

TABLE 49

The BDO, 4HB and GBL production in three replicates of the strains 1889 and 2471. The ALD and ADH were present on the plasmid pZS* to allow the conversion of 4-HB CoA to 4-HB aldehyde and subsequently to BDO. All concentrations are in mM and were measured after 24 hours of culture time in 96-well plates.

| Host | OD | 4HB | BDO | GBL |
|---|---|---|---|---|
| 1889 | 3.63 | 5.71 | 57.20 | 4.48 |
| 1889 | 3.05 | 5.65 | 50.60 | 3.49 |
| 1889 | 3.40 | 4.14 | 51.90 | 3.90 |
| 1889 | 3.19 | 4.23 | 53.10 | 3.69 |
| 2471 | 3.56 | 5.62 | 64.20 | 4.80 |
| 2471 | 2.96 | 5.73 | 53.30 | 2.75 |
| 2471 | 3.07 | 5.39 | 42.80 | 2.67 |
| 2471 | 3.11 | 4.01 | 45.90 | 2.66 |

Figure 88:
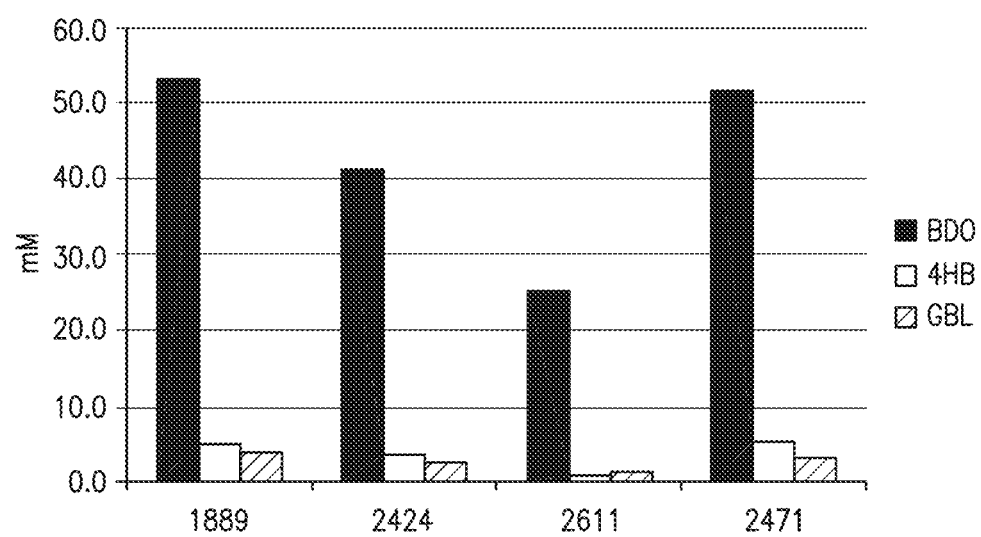
FIG. 88 shows the average BDO, 4HB and GBL numbers of the strains, 1889, 2424, 2611 and 2471.

FIG. 88 shows the average BDO, 4HB and GBL numbers of the strains, 1889 (see above) and 2471. These results demonstrate that deletion of cytochrome oxidases results in deletion of appBC resulted in a decrease in BDO and 4HB production, although both BDO and 4HB are still produced in good quantities, and these cells are expected to exhibit improved energy efficiency that may be advantageous in scaled up fermentation conditions.

The results disclosed herein demonstrate high yield of desired products such as 4-HB, 4-HBal, 4-HBCoA, BDO or putrescine, in particular BDO. Such modifications have been demonstrated to increase product yield of BDO. Such beneficial modifications, including both increasing and decreasing expression of enzymes, resulted in decreased $CO_2$ loss, decreased by-product formation such as ethanol, acetate, pyruvate, alanine, glutamate and GBL. Additional modifications decreased backflux from desired products such as BDO into pathway intermediates or precursors such as those in the TCA cycle. Additional improvements have been made by identifying enzymes that more efficiently carry out a desired pathway reaction and optionally subjecting the enzyme to evolution to generate variants having improved characteristics such as increased substrate to product conversion, stability, and the like. Such enzymes have included cat2, aldehyde dehydrogenase and aldehyde dehydrogenase, as disclosed herein. In addition, various promoters have been tested to identify promoter variants that provide more efficient transcription of a gene. Additionally, as disclosed herein, various backflux and by-product reactions can decrease the efficiency of product formation in a desired pathway. In some cases, product yield can be increased by decreasing expression of a pathway enzyme if higher expression of the pathway enzyme results in an increase in by-product formation. For example, such a result has been observed with aldehyde dehydrogenas, in which lower expression reduces ethanol production without lowering BDO production.

Example XXXX

Overexpression of Acetate Kinase and Phosphotransacetylase

This example describes overexpression of acetate kinase and phosphotransacetylase which improves the production of 4HB and BDO.

ackA refers to a gene that encodes for acetate kinase activity. pta refers to a gene that encodes for phosphotransacetylase activity. The net reaction catalyzed by both enzymes involves the conversion of acetate, ATP, and CoA into acetyl-CoA, ADP and phosphate. The overexpression of acetate kinase and phosphotransacetylase leads to increased conversion of acetate to acetyl-CoA, thus reducing the secretion of acetate and increasing the production of 4hb and BDO. The *E. coli* ackA (NP_416799.1, GI:16130231) and pta (NP_416800.1, GI: 16130232) genes were cloned on the plasmid pZS*13S under control of the weak constitutive promoter, p107. Expression of ackA and pta in such strains is thus increased over native levels.

Table 50 shows BDO, 4HB, and acetate production in a 96-well plate from the strain 4539 containing either an empty plasmid, pZS*13S, or containing a plasmid, pZS*13S-p107-301-302, that expresses ackA (301) and pta (302). The host strain 4539 is based on strain 3162 whose construction is described above. Strain 4539 contains chromosomally integrated copies of 4-hydroxybutyryl-CoA reductase (ALD), 4-hydroxybutyryaldehyde reductase (ADH) and 4-hydroxybutyryl-CoA transferase expressed from constitutive promoters. The genes used for these enzyme steps are described herein. The ADH was integrated on the chromosome under the promoter p119 at the hemN locus. The ALD was integrated on the chromosome under the promoter p119 at the aspA locus. The 4-hydroxybutyryl-CoA transferase was integrated on the chromosome at the attB locus under the p119 promoter. Strain 4539 additionally contains deletions in succinyl-CoA synthetase (sucCD) and a prophage integration site (ycil). In addition, the native promoter of ppc was replaced with a stronger constitutive promoter. Strain 4539 also contains an inactivated arcA gene. Table 50 shows that expression of acetate kinase and phosphotransacetylase enhances 4HB and/or BDO production while reducing acetate production in strain 4539 versus the controls denoted by "pZS*13S". Cells were cultured using the 96 well-plate protocol described previously above.

TABLE 50

BDO, 4HB, and acetate production of E. coli host strain 4539 containing either the plasmid construct denoted by "pZS*13S" which is empty or the plasmid construct denoted by "pZS*13S-p107-301-302" which expresses both ackA (301) and pta (302). BDO, 4HB, and acetate concentrations are in mM.

| Host | Plasmid #1 | OD | 4HB | BDO | Acetate |
|---|---|---|---|---|---|
| 4539 | pZS*13S-p107-301-302 | 3.04 | 10.90 | 63.70 | 0.21 |
| 4539 | pZS*13S-p107-301-302 | 2.69 | 11.30 | 62.00 | Not measured |
| 4539 | pZS*13S-p107-301-302 | 2.56 | 10.40 | 61.60 | Not measured |
| 4539 | pZS*13S-p107-301-302 | 2.78 | 9.74 | 62.00 | Not measured |
| 4539 | pZS*13S-p107-301-302 | 2.99 | 12.20 | 61.50 | 1.00 |
| 4539 | pZS*13S-p107-301-302 | 2.85 | 11.90 | 62.10 | Not measured |
| 4539 | pZS*13S-p107-301-302 | 2.81 | 10.70 | 62.20 | Not measured |
| 4539 | pZS*13S-p107-301-302 | 2.95 | 12.60 | 64.10 | Not measured |
| 4539 | pZS*13S | 2.33 | 11.50 | 31.50 | 1.98 |
| 4539 | pZS*13S | 1.18 | 6.86 | 20.00 | Not measured |
| 4539 | pZS*13S | 1.41 | 7.17 | 21.60 | Not measured |
| 4539 | pZS*13S | 1.92 | 11.50 | 30.10 | Not measured |

Example XXXXI

Inactivation of arcA

This example describes the inactivation of the global regulator, arcA, which improves the production of 4HB and BDO.

An arcA mutation was reported to abolish function (Iuchi et al., Proc. Natl. Acad Sci. USA 85:1888-1892 (1988)). It was later characterized (Silverman et al., J. Bacteriol. 173 (18):5648-5652 (1991)) and found to have an 8 amino acid insertion near the N-terminus of the protein (see sequence below). To test the effect of this arcA mutation, we restored the mutant and wild-type versions of arcA in strain 3162, described above and which contains a deletion in arcA, to create strains 3353 and 3511, respectively. In both strains, the ALD and ADH were expressed in E. coli from the pZS*-13S plasmid to allow a functional pathway from 4-hydroxybutyryl-CoA to 1,4-butanediol. Table 51 shows that 4HB and BDO production are higher in strain 3353, which contains the inactivated arcA gene, compared to strain 3511, which contains the wild-type arcA gene. Cells we red using the 96 well-plate protocol described previously.

TABLE 51

BDO, 4HB, and glutamate production of E. coli host strains 3353 (which contains an inactivated arcA) and 3511 (which contains wild-type arcA). BDO, 4HB, and acetate concentrations are in mM.

| Host | Plasmid | OD | 4HB | BDO | Glu |
|---|---|---|---|---|---|
| 3353 | pZS*13S-ALD-ADH | 3.8 | 0.77 | 57.3 | 0.00 |
| 3353 | pZS*13S-ALD-ADH | 3.8 | 0.77 | 54.6 | 0.00 |
| 3353 | pZS*13S-ALD-ADH | 3.9 | 0.78 | 60.0 | 0.00 |
| 3353 | pZS*13S-ALD-ADH | 3.7 | 0.89 | 63.1 | 0.00 |
| 3511 | pZS*13S-ALD-ADH | 3.1 | 0.28 | 17.1 | 0.45 |
| 3511 | pZS*13S-ALD-ADH | 3.0 | 0.35 | 17.5 | 0.43 |
| 3511 | pZS*13S-ALD-ADH | 2.7 | 0.20 | 10.8 | 0.44 |
| 3511 | pZS*13S-ALD-ADH | 3.1 | 0.03 | 11.7 | 0.46 |

The method for restoration of the mutant arcA gene is described below. All cloning for the insertion or deletion of genes in the chromosome of E. coli were based on the utilization of the sacB gene from Bacillus subtilis (ncbi.nlm-.nih.gov/pubmed?term=6402497). The vector used is pRE118 (ATCC87693) deleted of the oriT and IS sequences. The resulting vector (3.6 kb in size and carrying the kanamycin resistance gene) was sequenced and called pRE118-V2. All clonings of fragments were done into the restriction sites KpnI and PstI of pRE118-V2, unless otherwise indicated. All PCR amplification used genomic DNA from E. coli MG1655 (ATCC47076) as DNA template. The first integration event in the chromosome was selected on LB agar plates containing Kanamycin (25 or 50 mg/L). Clones with the correct insertion were selected for resolution. They were sub-cultured twice in plain liquid LB at the desired temperature and serial dilutions were plated on LB-no salt-sucrose 10% plates. Clones that grew on sucrose containing plates were screened for the loss of the kanamycin resistance gene on LB-low salt agar medium and the deletion/insertion of the fragment of interest was verified by PCR and sequencing of the encompassing region.

The E. coli arcA gene was amplified by PCR using genomic DNA form E. coli MG1655 and primers primers ArcA-up-KpnI (5'-tattattatggtaccaatatcatgcagcaaacggtgcaa-cattgccg-3'; SEQ ID NO:34) and ArcA-down-PstI (5'-ataaaaccctgcagcggaaacgaagttttatccattttggttacctg-3'; SEQ ID NO:36). The fragment was subsequently digested with the restriction enzymes KpnI and PstI, then ligated into the pRE118-V2 plasmid digested with PstI and KpnI, leading to plasmid pRE118-arcA. The nucleotide sequence of the arcA fragment was verified. An 8 amino acid insertion EGYDVFEA (SEQ ID NO:181) was created by site-directed mutagenesis using primers arcA-8aa-mut-frw 5'-AT-GATGTTTTCGAAGCGGAAGGCTATGATGTTT-TCGAAGCGACAGATGGCGCGGAAATGCA TCA-GATCC-3' (SEQ ID NO: 182) and arcA-8aa-mut-rev 5'-TTTCCGCGCCATCTGTCGCTTCGAAAACATCAT-AGCCTTCCGCTTCGAAAACATCATAGCCT TCCGCTTCG-3' (SEQ ID NO:183). This 8 AA insertion was located as described in Silverman et al., J. Bact. (173) 18:5648-5652 (1991)).

pRE118-arcA* was introduced into electro-competent cells of E. coli. After integration and resolution on LB-no salt-sucrose plates as described above, the sequence of the arcA region in the chromosome was verified by sequencing using primers arcA-diag-up2 5'-taatgatatttcgcccgactgcgc-3' (SEQ ID NO: 184) and arcA-diag2-down 5'-aatgaacggtatt-tatttgcaagcgg-3' (SEQ ID NO: 185) and is as follows (the nucleotide sequence of the wild-type arcA gene is underlined, and the added fragment shown in bold):

253

(SEQ ID NO: 186)
TAATGATATTTCGCCCGACTGCGCGCAGTGGTGGCGACAGTGAAATCGAC

ATCGTGTAACGATTCAGCCAATGTCGGGAAAACTTTAATATTATCAATAA

TATCACCAGATCCATGTGCGACCCAGCGGGTGGCTGGCTCCAGGTGTGCC

TGACTATCGACAATCCGCAGATCGCTAAACCCCATCGTTTTCATTGCCCG

CGCCGCTGCCCCAATATTTTCTGCTCTGGCGGGTGCGACCAGAATAATCG

TTATACGCATATTGCCACTCTTCTTGATCAAATAACCGCGAACCGGGTGA

TCACTGTCAACTTATTACGCGGTGCGAATTTACAAATTCTTAACGTAAGT

CGCAGAAAAGCCCTTTACTTAGCTTAAAAAAGGCTAAACTATTTCCTGA

CTGTACTAACGGTTGAGTTGTTAAAAAATGCTACATATCCTTCTGTTTAC

TTAGGATAATTTTATAAAAAATAAATCTCGACAATTGGATTCACCACGTT

TATTAGTTGTATGATGCAACTAGTTGGATTATTAAAATAATGTGACGAAA

GCTAGCATTTAGATACGATGATTTCATCAAACTGTTAACGTGCTACAATT

GAACTTGATATATGTCAACGAAGCGTAGTTTTATTGGGTGTCCGGCCCCT

CTTAGCCTGTTATGTTGCTGTTAAAATGGTTAGGATGACAGCCGTTTTG

ACACTGTCGGGTCCTGAGGGAAAGTACCCACGACCAAGCTAATGATGTTG

TTGACGTTGATGGAAAGTGCATCAAGAACGCAATTACGTACTTTAGTCAT

GTTACGCCGATCATGTTAATTTGCAGCATGCATCAGCAGGTCAGGGACTT

TTGTACTTCCTGTTTCGATTTAGTTGGCAATTTAGGTAGCAAAC<u>ATGCAG</u>

<u>ACCCCGCACATTCTTATCGTTGAAGACGAGTTGGTAACACGCAACACGTT</u>

<u>GAAAAGTATTTTCGAAGCG</u>GAAGGCTATGATGTTTTCGAAGCG<u>GAAGGCT</u>

<u>ATGATGTTTTCGAAGCGACAGATGGCGCGGAAATGCATCAGATCCTCTCT</u>

<u>GAATATGACATCAACCTGGTGATCATGGATATCAATCTGCCGGGTAAGAA</u>

<u>CGGTCTTCTGTTAGCGCGTGAACTGCGCGAGCAGGCGAATGTTGCGTTGA</u>

<u>TGTTCCTGACTGGCCGTGACAACGAAGTCGATAAAATTCTCGGCCTCGAA</u>

<u>ATCGGTGCAGATGACTACATCACCAAACCGTTCAACCCGCGTGAACTGAC</u>

<u>GATTCGTGCACGCAACCTACTGTCCCGTACCATGAATCTGGGTACTGTCA</u>

<u>GCGAAGAACGTCGTAGCGTTGAAAGCTACAAGTTCAATGGTTGGGAACTG</u>

<u>GACATCAACAGCCGTTCGTTGATCGGCCCTGATGGCGAGCAGTACAAGCT</u>

<u>GCCGCGCAGCGAGTTCCGCGCCATGCTTCACTTCTGTGAAAACCCAGGCA</u>

<u>AAATTCAGTCCCGTGCTGAACTGCTGAAGAAAATGACCGGCCGTGAGCT</u>

<u>AAACCGCACGACCGTACTGTAGACGTGACGATCCGCCGTATTCGTAAACA</u>

<u>TTTCGAATCTACGCCGGATACGCCGGAAATCATCGCCACCATTCACGGTG</u>

<u>AAGGTTATCGCTTCTGCGGTGATCTGGAAGATTAA</u>TCGGCTTTACCACCG

TCAAAAAAACGGCGCTTTTTAGCGCCGTTTTTATTTTTCAACCTTATTT

CCAGATACGTAACTCATCGTCCGTTGTAACTTCTTTACTGGCTTTCATTT

TCGGCAGTGAAAACGCATACCAGTCGATATTACGGGTCACAAACATCATG

CCGGCCAGCGCCACCACCAGCACACTGGTTCCCAACAACAGCGCGCTATC

GGCAGAGTTGAGCAGTCCCCACATCACACCATCCAGCAACAACAGCGCGA

GGGTAAACAACATGCTGTTGCACCAACCTTTCAATACCGCTTGCAAATAA

ATACCGTTCATTA.

254

Example XXXXII

Truncation of crr

This example describes improved 4-HB and BDO production using a truncated variant of the glucose PTS permease IIA domain.

To achieve higher BDO titer and yield, the rate of glucose uptake and glycolytic flux can be balanced with the rate of BDO production. One mechanism for balancing these fluxes is to alter one or more components of a glucose transporter. In this example, improved BDO production was demonstrated using a truncated variant of the glucose PTS permease component IIA (EIIA[Glc]), encoded by crr. The glucose PTS system transports and simultaneously phosphorylates glucose, releasing glucose-6-phosphate into the cytoplasm and concomitantly converting phosphoenolpyruvate to pyruvate. The IIA[Glc] component mediates the transfer of the phosphoryl group from histidine protein Hpr (ptsH) to the IIB[Glc] (ptsG) component. A truncated variant of the crr gene was introduced into BDO producing strains. The resulting gene is called 2311A (crr*). The DNA sequence of 2311A is shown in Table 52. Strains with the crr variant exhibit reduced production of the byproducts acetate, pyruvate and glutamate, and an increase in BDO titers and yields. Without being bound by a particular theory, the truncated variant is expected to slow down glucose uptake, thereby balancing flux through glycolysis with BDO production.

To test the performance of truncated crr relative to the wild type protein, a wild-type crr variant was restored in the strain ECKh-5491, resulting in the strain ECKh-5717. The host strain ECKh-5491 is based on strain ECKh-432 whose construction is described above and in US20110045575. Notable modifications include in deletions in adhE, ldhA, pflB and mdh. Strain ECKh-5491 also contains chromosomally integrated copies of sucD from *Porphyromonas gingivalis* (encoding CoA-dependant succinate semialdehyde dehydrogenase) and 4hbd from *P. gingivalis* (encoding 4-hydroxybutyrate dehydrogenase). Additionally, strain 5491 contains chromosomally integrated copies of 4-hydroxybutyryl-CoA reductase (ALD), 4-hydroxybutyryaldehyde reductase (ADH) and 4-hydroxybutyryl-CoA transferase. The genes for these enzyme steps are described herein. The ADH was integrated on the chromosome under the promoter p119 at the hemN locus. The ALD was integrated on the chromosome under the promoter p119 at the aspA locus. The 4-hydroxybutyryl-CoA transferase was integrated on the chromosome at the attB locus under the p119 promoter. Strain 5491 contains deletions in the native alcohol dehydrogenase genes adhP, yqhD, yahK, and yjgB. This strain also has deletions of cytochrome oxidases, cyoABCD and appBC, succinyl-CoA synthetase (sucCD), a prophage integration site (yciI) and flagellar biosynthesis genes (flhCD, motA), the predicted transporter (yebQ), aspartate-ammonia lyase (aspA), the ferrichrome/phage/antibiotic outer membrane porin (fhuA), glutamate synthase (gltBD), a low specificity threonine aldolase (ltaE), PEP carboxykinase (pckA), the glycine cleavage system component (gcvT), the maltose outer membrane porin/phage lambda receptor protein (lamB), and the fimbriae genes (fimABCDEFGHI). In addition, the native promoter of ppc was replaced with a stronger constitutive promoter. Strain 5491 also contains an inactivated arcA gene. Several native genes are overexpressed on a low-copy plasmid in both 5491 and 5717: ackA, pta, sucA, sucB and lpd4.

Table 52 shows OD and LCMS data for BDO, 4HB, acetate and pyruvate levels of the strain with the crr-variant ECKh-5491(2311A) with respect to the control, 5717 (crr-wt). Four replicates of each strain were cultured in 24-well plates. All concentrations are in mM and were measured after 24 hours of culture time. Higher BDO and 4HB were observed in cells with the truncated crr variant 2311A. Additionally, the crr variant produced lower levels of the byproducts ethanol and pyruvate. Gene sequence for 2311A (crr*) SEQ ID NO:187.

TABLE 52

BDO, 4HB, acetate and pyruvate levels of the strain with the crr-variant ECKh-5491(2311A) with respect to the control, 5717 (crr-wt).

| Host | OD 24 h | BDO | 4HB | Acetate | Pyruvate |
|------|---------|-------|------|---------|----------|
| 5491 | 19.82 | 216.0 | 22.8 | 4.8 | 1.1 |
| 5491 | 11.46 | 247.0 | 24.6 | 3.2 | 1.1 |
| 5491 | 12.67 | 248.0 | 27.6 | 4.3 | 1.1 |
| 5491 | 7.14 | 248.0 | 28.3 | 3.6 | 1.1 |
| 5717 | 37.81 | 199.0 | 18.1 | 64.9 | 46.3 |
| 5717 | 30.89 | 168.0 | 18.7 | 69.7 | 50.4 |
| 5717 | 22.97 | 179.0 | 18.9 | 78.3 | 52.4 |
| 5717 | 25.43 | 157.0 | 18.2 | 48.0 | 33.1 |

Gene sequence for 2311A (crr*):

atgggtttgttcgataaactgaaatctctggtttccgacgacaagaagga taccggaactattgagatcattgctccgctctctggcgagatcgtcaata tcgaagacgtgccggatgtcgtttttgcggaaaaaatcgttggtgatggt attgctatcaaaccaacgggtaacaaaatggtcgcgccagtagacggcac cattggtaaaatctttgaaaccaaccacgcattctctatcgaatctgata gcggcgttgaactgttcgtccacttcggtatcgacaccgttgaactgaaa ggcgaaggcttcaagcgtattgctgaagaaggtcagcgcgtgaaagttgg cgatactgtcattgaatttgatctgccgctgctggaagagaaagccaagt ctaccctgactccggttgttatctccaacatggacgaaatcaaagaactg atcaaactgtccggtagcgtaaccgtgggtgaaacccataagcgctaa
(SEQ ID NO: 187)

Example XXXXIII

Additional BDO and 4HB Producing Strains with Enzyme Variants

This examples describes enzyme variants providing production of BDO, 4HB and/or other intermediates in a 4HB or BDO pathway.

Variants of cat2 were generated using site-directed mutagenesis and/or saturation mutagenesis and/or error-prone PCR and/or directed evolution. Variants were screened for production of products and/or byproducts such as BDO or ethanol in high-throughput assays or in in vitro assays as well as for product inhibition, such as with BDO. Additional variants were generated by random combinations of mutations.

Exemplary screening methods for Cat2 activity include, for example, Cat2 in vitro activity assay and in vivo assay for BDO or BDO and ethanol production. With respect to the Cat2 in vitro activity, the respective clones carrying a plasmid with a Strep-tagged gene construct were grown in LB medium and induced with IPTG (0.2 mM) for Cat2 expression. Cells were collected by centrifugation and then lysed (either chemically or by sonication). Cell debris was removed by centrifugation and the obtained supernatant diluted in binding buffer (12.5 mM Tris/HCl pH 7.5, 1 mM EDTA, 70 mM NaCl). 200 µl of the diluted supernatant was added per well to a StrepTactin coated plate. The plate was incubated for 2 hours at 4° C. to allow adsorption of the strep-tagged protein to the plate. After the incubation, unbound lysate components were removed by washing three times with wash buffer (200 µl of 0.05% Tween 20 in phosphate buffered saline). Cat2 activity was measured by monitoring the production of acetate after addition of substrate (20 mM 4-hydroxybutyrate, 2 mM acetyl-CoA) by addition of a commercially available acetate quantification reagent. To measure inhibition of Cat2, the assay was performed in the absence and presence of BDO (up to 1M).

With respect to the in vivo assay for measuring BDO and ethanol, a high throughput in vivo assay was performed. Briefly, a BDO production strain harboring variants of the cat2 gene was grown in 96 well-plate format. After 16 hours of growth in a micro-aerobic environment, the culture supernatant was assayed for BDO or ethanol. Both detection methods utilized an enzymatic conversion of the alcohol (1,4 butanediol or ethanol) to the respective aldehyde (4-hydroxybutryaldhyde or acetaldehyde) via formation of NAD(P)H, monitored at 340 nm. The assays were conducted in 96 well polystryrene plates with 200 µl assay mixture. The assay mixture for BDO detection contained 50 mM Tris pH 7.4, 5 mM NADP+ and 3 µg of a BDO-specific alcohol dehydrogenase. The assay mixture for ethanol detection contained 50 mM Tris pH 7.4, 5 mM NAD+ and 3 µg of an ethanol-specific alcohol dehydrogenase. The enzyme reaction was initiated with addition of 10 µl of spent media and allowed to proceed for 30 min at 42° C. The final concentration of BDO or ethanol is determined by extrapolation to a standard curve. Variant enzymes were identified that exhibited increased activity in the presence of BDO. Certain variants exhibited activity of about 1.2 fold, about 2.5-fold, or about 2.8-fold higher activity in the presence of BDO than wild type. Variants with combinations of two or more variant amino acid positions exhibited activities greater than wild type. Generating enzyme variants by combining active variant amino acid positions resulted in enzyme variants with improved properties.

Table 53 provides exemplary cat2 sequences based on homology. One skilled in the art will readily understand that such sequences can be analyzed with routine and well known methods for aligning sequences (for example BLAST, blast.ncbi.nlm.nih.gov; Altschul et al., "*J. Mol. Biol.* 215:403-410 (1990)). Such alignments can provide information on conserved residues that can be utilized to identify a consensus sequence for preserving enzyme activity as well as positions for generating further enzyme variants.

TABLE 53

Exemplary cat2 sequences.

| Description | Accession No. |
|---|---|
| hypothetical protein HMPREF0404_00865 [*Fusobacterium* sp. 21_1A] >gb\|EGN64817.1\| hypothetical protein HMPREF0404_00865 [*Fusobacterium* sp. 21_1A] | ZP_08581574.1 GI:336400801 (SEQ ID NO: 248) |
| acetyl-CoA hydrolase [*Fusobacterium* sp. 3_1_33] >gb\|EEW95213.1\| acetyl-CoA hydrolase [*Fusobacterium* sp. 3_1_33] | ZP_05814664.1 GI:260494534 (SEQ ID NO: 249) |
| 4-hydroxybutyrate coenzyme A transferase [*Fusobacterium* sp. 7_1] >ref\|ZP_06523842.1\| 4-hydroxybutyrate coenzyme A transferase [*Fusobacterium* sp. D11] >gb\|EEO42114.1\| 4-hydroxybutyrate coenzyme A transferase [*Fusobacterium* sp. 7_1] >gb\|EFD80031.1\| 4-hydroxybutyrate coenzyme A transferase [*Fusobacterium* sp. D11] | ZP_04575154.1 GI:237744673 (SEQ ID NO: 250) |
| 4-hydroxybutyrate CoA-transferase [*Fusobacterium* sp. 11_3_2] >gb\|EGN63628.1\| 4-hydroxybutyrate CoA-transferase [*Fusobacterium* sp. 11_3_2] | ZP_08598403.1 GI:336418124 (SEQ ID NO: 251) |
| acetyl-CoA hydrolase [*Desulfomonile tiedjei* DSM 6799] >gb\|AFM24316.1\| acetyl-CoA hydrolase [*Desulfomonile tiedjei* DSM 6799] | YP_006446580.1 GI:392409973 (SEQ ID NO: 252 |
| 4-hydroxybutyrate coenzyme A transferase [*Porphyromonas uenonis* 60-3] >gb\|EEK17275.1\| 4-hydroxybutyrate coenzyme A transferase [*Porphyromonas uenonis* 60-3] | ZP_04054791.1 GI:228469852 (SEQ ID NO: 253) |
| acetyl-CoA hydrolase/transferase [*Pelosinus fermentans* DSM 17108] >gb\|EIW32362.1\| acetyl-CoA hydrolase/transferase [*Pelosinus fermentans* DSM 17108] | ZP_10325539.1 GI:392960066 (SEQ ID NO: 254) |
| 4-hydroxybutyrate coenzyme A transferase [*Megasphaera* sp. UPII 135-E] >gb\|EGS33214.1\| 4-hydroxybutyrate coenzyme A transferase [*Megasphaera* sp. UPII 135-E] | ZP_08710943.1 GI:342218327 (SEQ ID NO: 255) |
| acetyl-CoA hydrolase/transferase [*Pelosinus fermentans* B4] >ref\|ZP_15522476.1\| acetyl-CoA hydrolase/transferase [*Pelosinus fermentans* B3] >ref\|ZP_15526118.1\| acetyl-CoA hydrolase/transferase [*Pelosinus fermentans* A12] >ref\|ZP_15532060.1\| acetyl-CoA hydrolase/transferase [*Pelosinus fermentans* A11] >gb\|EIW19212.1\| acetyl-CoA hydrolase/transferase [*Pelosinus fermentans* B4] >gb\|EIW25056.1\| acetyl-CoA hydrolase/transferase [*Pelosinus fermentans* A11] >gb\|EIW34652.1\| acetyl-CoA hydrolase/transferase [*Pelosinus fermentans* B3] >gb\|EIW37648.1\| acetyl-CoA hydrolase/transferase [*Pelosinus fermentans* A12] | ZP_15516677.1 GI:421053705 (SEQ ID NO: 256) |
| 4-hydroxybutyrate CoA-transferase [*Fusobacterium periodonticum* ATCC 33693] >gb\|EFE85797.1\| 4-hydroxybutyrate CoA-transferase [*Fusobacterium periodonticum* ATCC 33693] | ZP_06027623.1 GI:262068011 (SEQ ID NO: 257) |
| 4-hydroxybutyrate CoA-transferase [*Fusobacterium nucleatum* subsp. *animalis* ATCC 51191] >gb\|EGQ78661.1\| 4-hydroxybutyrate CoA-transferase [*Fusobacterium nucleatum* subsp. *animalis* ATCC 51191] | ZP_16968033.1 GI:422945708 (SEQ ID NO: 258) |
| 4-hydroxybutyrate coenzyme A transferase [*Fusobacterium* sp. 4_1_13] >gb\|EEO40050.1\| 4-hydroxybutyrate coenzyme A transferase [*Fusobacterium* sp. 4_1_13] | ZP_04572671.1 GI:237742190 (SEQ ID NO: 259) |
| 4-hydroxybutyrate coenzyme A transferase [*Fusobacterium* sp. 2_1_31] >ref\|ZP_16398352.1\| hypothetical protein FPOG_01423 [*Fusobacterium periodonticum* D10] >gb\|EEO37750.1\| 4-hydroxybutyrate coenzyme A transferase [*Fusobacterium* sp. 2_1_31] >gb\|EKA92776.1\| hypothetical protein FPOG_01423 [*Fusobacterium periodonticum* D10] | ZP_08689706.1 GI:340752912 (SEQ ID NO: 260) |
| 4-hydroxybutyrate CoA-transferase [*Fusobacterium nucleatum* ChDC F128] >gb\|EJU07208.1\| 4-hydroxybutyrate CoA-transferase [*Fusobacterium nucleatum* ChDC F128] | ZP_15973607.1 GI:421527002 (SEQ ID NO: 261) |
| 4-hydroxybutyrate CoA-transferase [*Fusobacterium* sp. 1_1_41FAA] >gb\|EFG28576.1\| 4-hydroxybutyrate CoA-transferase [*Fusobacterium* sp. 1_1_41FAA] | ZP_06747486.1 GI:294782160 (SEQ ID NO: 262) |
| 4-hydroxybutyrate CoA-transferase [*Fusobacterium nucleatum* subsp. *fusiforme* ATCC 51190] >gb\|EJG09667.1\| 4-hydroxybutyrate CoA-transferase [*Fusobacterium nucleatum* subsp. *fusiforme* ATCC 51190] | ZP_15604676.1 GI:421144770 (SEQ ID NO: 263) |
| hypothetical protein HMPREF9942_00351 [*Fusobacterium nucleatum* subsp. *animalis* F0419] >gb\|EHO79348.1\| hypothetical protein HMPREF9942_00351 [*Fusobacterium nucleatum* subsp. *animalis* F0419] | ZP_17124213.1 GI:423136570 (SEQ ID NO: 264) |
| acetyl-CoA hydrolase [*Fusobacterium nucleatum* subsp. *polymorphum* ATCC 10953] >gb\|EDK89708.1\| acetyl-CoA hydrolase [*Fusobacterium nucleatum* subsp. *polymorphum* ATCC 10953] | ZP_04971624.1 GI:254304266 (SEQ ID NO: 265) |
| acetyl-CoA hydrolase/transferase [*Roseiflexus* sp. RS-1] >gb\|ABQ89320.1\| acetyl-CoA hydrolase/transferase [*Roseiflexus* sp. RS-1] | YP_001275270.1 GI:148655065 (SEQ ID NO: 266) |
| acetyl-CoA hydrolase/transferase [*Porphyromonas asaccharolytica* DSM 20707] >gb\|AEE12399.1\| acetyl-CoA hydrolase/transferase [*Porphyromonas asaccharolytica* DSM 20707] | YP_004441567.1 GI:332299646 (SEQ ID NO: 267) |
| 4-hydroxybutyrate CoA-transferase [*Fusobacterium nucleatum* CC53] | EMP15468.1 GI:465143275 (SEQ ID NO: 268) |
| butyryl:4-hydroxybutyrate CoA transferase [*Geobacter bemidjiensis* Bem] >gb\|ACH38437.1\| butyryl:4-hydroxybutyrate coenzyme A transferase [*Geobacter bemidjiensis* Bem] | YP_002138233.1 GI:197117806 (SEQ ID NO: 269) |
| acetyl-CoA hydrolase [*Fusobacterium* sp. 3_1_36A2] >gb\|EEU32577.1\| acetyl-CoA | ZP_05550921.1 |

TABLE 53-continued

Exemplary cat2 sequences.

| Description | Accession No. |
|---|---|
| hydrolase [*Fusobacterium* sp. 3_1_36A2] | GI:256845463 (SEQ ID NO: 270) |
| 4-hydroxybutyrate CoA-transferase [*Fusobacterium* sp. 3_1_27] >gb|EFG34309.1| 4-hydroxybutyrate CoA-transferase [*Fusobacterium* sp. 3_1_27] | ZP_06750521.1 GI:294785233 (SEQ ID NO: 271) |
| 4-hydroxybutyrate CoA-transferase [*Eubacterium yurii* subsp. *margaretiae* ATCC 43715] >gb|EFM38414.1| 4-hydroxybutyrate CoA-transferase [*Eubacterium yurii* subsp. *margaretiae* ATCC 43715] | ZP_07455129.1 GI:306821529 (SEQ ID NO: 272) |
| acetyl-CoA hydrolase/transferase [*Roseiflexus castenholzii* DSM 13941] >gb|ABU59812.1| acetyl-CoA hydrolase/transferase [*Roseiflexus castenholzii* DSM 13941] | YP_001433830.1 GI:156743701 (SEQ ID NO: 273) |
| 4-hydroxybutyrate coenzyme A transferase [*Fusobacterium nucleatum* subsp. *nucleatum* ATCC 25586] >ref|ZP_06870070.1| 4-hydroxybutyrate CoA-transferase [*Fusobacterium nucleatum* subsp. *nucleatum* ATCC 23726] >gb|AAL94817.1| 4-hydroxybutyrate coenzyme A transferase [*Fusobacterium nucleatum* subsp. *nucleatum* ATCC 25586] >gb|EFG96121.1| 4-hydroxybutyrate CoA-transferase [*Fusobacterium nucleatum* subsp. *nucleatum* ATCC 23726] | NP_603518.1 GI:19703956 (SEQ ID NO: 274) |
| 4-hydroxybutyrate coenzyme A transferase [*Porphyromonas asaccharolytica* PR426713P-I] >gb|EFR33883.1| 4-hydroxybutyrate coenzyme A transferase [*Porphyromonas asaccharolytica* PR426713P-I] | ZP_07821110.1 GI:313887421 (SEQ ID NO: 275) |
| 4-hydroxybutyrate CoA-transferase [*Imtechella halotolerans* K1] >gb|EID75748.1| 4-hydroxybutyrate CoA-transferase [*Imtechella halotolerans* K1] | ZP_09999308.1 GI:384098189 (SEQ ID NO: 276) |
| 4-hydroxybutyrate CoA-transferase [*Fusobacterium nucleatum* subsp. *polymorphum* F0401] >gb|EHG18330.1| 4-hydroxybutyrate CoA-transferase [*Fusobacterium nucleatum* subsp. *polymorphum* F0401] | ZP_16420483.1 GI:422339525 (SEQ ID NO: 277) |
| 4-hydroxybutyrate coenzyme A transferase [*Eubacterium* sp. AS15] >gb|EJP19825.1| 4-hydroxybutyrate coenzyme A transferase [*Eubacterium* sp. AS15] | ZP_10829831.1 GI:402310872 (SEQ ID NO: 278) |
| acetyl-CoA hydrolase [*Desulfosporosinus acidiphilus* SJ4] >gb|AFM41652.1| acetyl-CoA hydrolase [*Desulfosporosinus acidiphilus* SJ4] | YP_006466984.1 GI:392425990 (SEQ ID NO: 279) |
| putative butyryl-CoA:acetate CoA-transferase [*Flavonifractor plautii* ATCC 29863] >gb|EHM42532.1| putative butyryl-CoA:acetate CoA-transferase [*Flavonifractor plautii* ATCC 29863] | ZP_09385293.1 GI:365844447 (SEQ ID NO: 280) |
| hypothetical protein CarbS_08493 [*Clostridium arbusti* SL206] | ZP_10774427.1 GI:399888550 (SEQ ID NO: 281) |
| acetyl-CoA hydrolase/transferase [*Clostridium carboxidivorans* P7] >ref|ZP_06857150.1| acetyl-CoA hydrolase/transferase [*Clostridium carboxidivorans* P7] >gb|EET84247.1| acetyl-CoA hydrolase/transferase [*Clostridium carboxidivorans* P7] >gb|EFG86097.1| acetyl-CoA hydrolase/transferase [*Clostridium carboxidivorans* P7] | ZP_05395303.1 GI:255528520 (SEQ ID NO: 282) |
| 4-hydroxybutyrate CoA-transferase [*Tannerella forsythia* ATCC 43037] >gb|AEW22101.1| 4-hydroxybutyrate coenzyme A transferase [*Tannerella forsythia* ATCC 43037] | YP_005014371.1 GI:375255204 (SEQ ID NO: 283) |
| acetyl-CoA hydrolase/transferase domain-containing protein [*Anaerostipes* sp. 3_2_56FAA] >gb|EFV21594.1| acetyl-CoA hydrolase/transferase domain-containing protein [*Anaerostipes* sp. 3_2_56FAA] | ZP_07932276.1 GI:317472972 (SEQ ID NO: 284) |
| 4-hydroxybutyrate:acetyl-CoA transferase [*Fusobacterium* sp. 3_1_5R] >gb|EFS22200.1| 4-hydroxybutyrate:acetyl-CoA transferase [*Fusobacterium* sp. 3_1_5R] | ZP_07924174.1 GI:317059689 (SEQ ID NO: 285) |
| acetyl-CoA hydrolase/transferase [*Geobacter* sp. M21] >gb|ACT18894.1| acetyl-CoA hydrolase/transferase [*Geobacter* sp. M21] | YP_003022652.1 GI:253701463 (SEQ ID NO: 286) |
| acetyl-CoA hydrolase [*Desulfosporosinus acidiphilus* SJ4] >gb|AFM40672.1| acetyl-CoA hydrolase [*Desulfosporosinus acidiphilus* SJ4] | YP_006466004.1 GI:392425010 (SEQ ID NO: 287) |
| hypothetical protein CKL_3018 [*Clostridium kluyveri* DSM 555] >ref|YP_002473131.1| hypothetical protein CKR_2666 [*Clostridium kluyveri* NBRC 12016] >sp|P38942.3|CAT2_CLOK5 RecName: Full = 4-hydroxybutyrate coenzyme A transferase >gb|EDK35026.1| Cat2 [*Clostridium kluyveri* DSM 555] >dbj|BAH07717.1| hypothetical protein [*Clostridium kluyveri* NBRC 12016] | YP_001396397.1 GI:153955632 (SEQ ID NO: 288) |
| LOW QUALITY PROTEIN: acetyl-CoA hydrolase [*Thermoanaerobacter siderophilus* SR4] >gb|EIW00535.1| LOW QUALITY PROTEIN: acetyl-CoA hydrolase [*Thermoanaerobacter siderophilus* SR4] | ZP_10305985.1 GI:392940341 (SEQ ID NO: 289) |
| 4-hydroxybutyrate:acetyl-CoA transferase [*Fusobacterium gonidiaformans* ATCC 25563] >ref|ZP_07924054.1| 4-hydroxybutyrate:acetyl-CoA transferase [*Fusobacterium* sp. 3_1_5R] >gb|EFS22080.1| 4-hydroxybutyrate:acetyl-CoA transferase [*Fusobacterium* sp. 3_1_5R] >gb|EFS29245.1| 4-hydroxybutyrate:acetyl-CoA transferase [*Fusobacterium gonidiaformans* ATCC 25563] | ZP_07914775.1 GI:315918535 (SEQ ID NO: 290) |
| 4-hydroxybutyrate coenzyme A transferase [*Fusobacterium varium* ATCC 27725] >gb|EES63001.1| 4-hydroxybutyrate coenzyme A transferase [*Fusobacterium varium* ATCC 27725] | ZP_08693772.1 GI:340757169 (SEQ ID NO: 291) |
| 4-hydroxybutyrate coenzyme A transferase [*Fusobacterium necrophorum* subsp. *funduliforme* ATCC 51357] >gb|EIJ68663.1| 4-hydroxybutyrate coenzyme A | ZP_14365187.1 GI:419841825 |

TABLE 53-continued

Exemplary cat2 sequences.

| Description | Accession No. |
|---|---|
| transferase [*Fusobacterium necrophorum* subsp. *funduliforme* ATCC 51357] | (SEQ ID NO: 292) |
| hypothetical protein ANACAC_00165 [*Anaerostipes caccae* DSM 14662] >gb|EDR99324.1| 4-hydroxybutyrate coenzyme A transferase [*Anaerostipes caccae* DSM 14662] | ZP_02417601.1 GI:167745474 (SEQ ID NO: 293) |
| 4-hydroxybutyrate coenzyme A transferase [*Clostridium* sp. MSTE9] >gb|EJF39044.1| 4-hydroxybutyrate coenzyme A transferase [*Clostridium* sp. MSTE9] | ZP_14664473.1 GI:420157643 (SEQ ID NO: 294) |
| hypothetical protein ANASTE_01215 [*Anaerofustis stercorihominis* DSM 17244] >gb|EDS71513.1| 4-hydroxybutyrate coenzyme A transferase [*Anaerofustis stercorihominis* DSM 17244] | ZP_02862002.1 GI:169334809 (SEQ ID NO: 295) |
| 4-hydroxybutyrate CoA-transferase [*Anaerostipes caccae*] | ABA39275.1 GI:76096774 (SEQ ID NO: 296) |
| 4-Hydroxybutyrate CoA-transferase [*Clostridium aminobutyricum*]. | CAB60036 GI:188032706 (SEQ ID NO: 297) |
| 4-Hydroxybutyrate CoA-transferase [*Clostridium aminobutyricum*] | CAB60036.2 GI:188032706 (SEQ ID NO: 298) |
| Chain A, Crystal Structure Of 4-Hydroxybutyrate Coa-Transferase From *Clostridium Aminobutyricum* >pdb|3GK7|B Chain B, Crystal Structure Of 4-Hydroxybutyrate Coa-Transferase From *Clostridium Aminobutyricum* >pdb|3QDQ|A Chain A, Complex Between 4-Hydroxybutyrate Coa-Transferase From *Clostridium Aminobutyricum* And Coa | 3GK7_A GI:281500759 (SEQ ID NO: 299) |
| 4-hydroxybutyrate CoA-transferase [*Eubacterium saphenum* ATCC 49989] >gb|EEU03839.1| 4-hydroxybutyrate CoA-transferase [*Eubacterium saphenum* ATCC 49989] | ZP_05427217.1 GI:255994082 (SEQ ID NO: 300) |
| putative butyryl-CoA:acetate CoA-transferase [*Clostridium difficile* 002-P50-2011] >ref|ZP_17075260.1| putative butyryl-CoA:acetate CoA-transferase [*Clostridium difficile* 050-P50-2011] >gb|EHJ25154.1| putative butyryl-CoA:acetate CoA-transferase [*Clostridium difficile* 002-P50-2011] >gb|EHJ27941.1| putative butyryl-CoA:acetate CoA-transferase [*Clostridium difficile* 050-P50-2011] | ZP_17072579.1 GI:423084074 (SEQ ID NO: 301) |
| 4-hydroxybutyrate CoA-transferase [*Clostridium difficile* 630] >ref|ZP_05272394.1| 4-hydroxybutyrate CoA transferase [*Clostridium difficile* QCD-66c26] >ref|ZP_05322787.1| 4-hydroxybutyrate CoA transferase [*Clostridium difficile* CIP 107932] >ref|ZP_05330465.1| 4-hydroxybutyrate CoA transferase [*Clostridium difficile* QCD-63q42] >ref|ZP_05356638.1| 4-hydroxybutyrate CoA transferase [*Clostridium difficile* QCD-76w55] >ref|ZP_05385401.1| 4-hydroxybutyrate CoA transferase [*Clostridium difficile* QCD-97b34] >ref|ZP_05397740.1| 4-hydroxybutyrate CoA transferase [*Clostridium difficile* QCD-37x79] >ref|YP_003215203.1| 4-hydroxybutyrate CoA transferase [*Clostridium difficile* CD196] >ref|YP_003218712.1| 4-hydroxybutyrate CoA transferase [*Clostridium difficile* R20291] >ref|ZP_07407078.1| 4-hydroxybutyrate CoA transferase [*Clostridium difficile* QCD-32g58] >ref|YP_006199406.1| 4-hydroxybutyrate CoA transferase [*Clostridium difficile* BI1] >ref|ZP_17080166.1| putative butyryl-CoA:acetate CoA-transferase [*Clostridium difficile* 70-100-2010] >emb|CAJ69226.1| 4-hydroxybutyrate CoA transferase [*Clostridium difficile* 630] >emb|CBA64187.1| 4-hydroxybutyrate CoA transferase [*Clostridium difficile* CD196] >emb|CBE05384.1| 4-hydroxybutyrate CoA transferase [*Clostridium difficile* R20291] >gb|EHJ35600.1| putative butyryl-CoA:acetate CoA-transferase [*Clostridium difficile* 70-100-2010] | YP_001088854.1 GI:126699957 (SEQ ID NO: 302) |
| 4-hydroxybutyrate CoA transferase [*Clostridium difficile* ATCC 43255] | ZP_05351533.1 GI:255307362 (SEQ ID NO: 303) |
| 4-hydroxybutyrate CoA transferase [*Clostridium difficile* QCD-23m63] >ref|ZP_06892006.1| 4-hydroxybutyrate CoA-transferase [*Clostridium difficile* NAP08] >ref|ZP_06902665.1| 4-hydroxybutyrate CoA-transferase [*Clostridium difficile* NAP07] >gb|EFH07842.1| 4-hydroxybutyrate CoA-transferase [*Clostridium difficile* NAP08] >gb|EFH16309.1| 4-hydroxybutyrate CoA-transferase [*Clostridium difficile* NAP07] | ZP_05401721.1 GI:255656312 (SEQ ID NO: 304) |
| 4-hydroxybutyrate coenzyme A transferase [*Clostridium* sp. MSTE9] >gb|EJF40677.1| 4-hydroxybutyrate coenzyme A transferase [*Clostridium* sp. MSTE9] | ZP_14663205.1 GI:420156362 (SEQ ID NO: 305) |
| hypothetical protein CarbS_12961 [*Clostridium arbusti* SL206] | ZP_10775305.1 GI:399889428 (SEQ ID NO: 306) |
| hypothetical protein HMPREF0995_05302 [*Lachnospiraceae* bacterium 7_1_58FAA] >gb|EHO23268.1| hypothetical protein HMPREF0995_05302 [*Lachnospiraceae* bacterium 7_1_58FAA] | ZP_09534466.1 GI:373120404 (SEQ ID NO: 307) |
| hypothetical protein HMPREF0995_04657 [*Lachnospiraceae* bacterium 7_1_58FAA] >gb|EHO27239.1| hypothetical protein HMPREF0995_04657 [*Lachnospiraceae* bacterium 7_1_58FAA] | ZP_09533821.1 GI:373119730 (SEQ ID NO: 308) |
| acetyl-CoA hydrolase/transferase [*Clostridium beijerinckii* NCIMB 8052] >gb|ABR34270.1| acetyl-CoA hydrolase/transferase [*Clostridium beijerinckii* NCIMB 8052] | YP_001309226.1 GI:150016972 (SEQ ID NO: 309) |

TABLE 53-continued

Exemplary cat2 sequences.

| Description | Accession No. |
|---|---|
| 4-hydroxybutyrate coenzyme A transferase [*Clostridium kluyveri* DSM 555] | AAA92344.1<br>GI:1228101<br>(SEQ ID NO: 310) |
| acetyl-CoA hydrolase/transferase [*Odoribacter splanchnicus* DSM 20712]<br>>gb|ADY33064.1| acetyl-CoA hydrolase/transferase [*Odoribacter splanchnicus* DSM 20712] | YP_004253244.1<br>GI:325280702<br>(SEQ ID NO: 311) |
| 4-hydroxybutyrate CoA-transferase [*Porphyromonas gingivalis* ATCC 33277]<br>>dbj|BAG33244.1| 4-hydroxybutyrate CoA-transferase [*Porphyromonas gingivalis* ATCC 33277] | YP_001928841.1<br>GI:188994589<br>(SEQ ID NO: 312) |
| hypothetical protein FUAG_02467 [*Fusobacterium ulcerans* ATCC 49185]<br>>gb|EFS26952.1| hypothetical protein FUAG_02467 [*Fusobacterium ulcerans* ATCC 49185] | ZP_10973595.1<br>GI:404368238<br>(SEQ ID NO: 313) |
| 4-hydroxybutyrate CoA-transferase [*Fusobacterium* sp. 11_3_2] >gb|EGN63583.1| 4-hydroxybutyrate CoA-transferase [*Fusobacterium* sp. 11_3_2] | ZP_08598358.1<br>GI:336418079<br>(SEQ ID NO: 314) |
| 4-hydroxybutyrate CoA-transferase [*Fusobacterium nucleatum* CC53] | EMP16460.1<br>GI:465144883<br>(SEQ ID NO: 315) |
| 4-hydroxybutyrate:acetyl-CoA CoA transferase [*Fusobacterium nucleatum* subsp. *vincentii* ATCC 49256] >gb|EAA24344.1| 4-hydroxybutyrate:acetyl-CoA CoA transferase [*Fusobacterium nucleatum* subsp. *vincentii* ATCC 49256] | ZP_00144049.1<br>GI:34763077<br>(SEQ ID NO: 316) |
| 4-hydroxybutyrate coenzyme A transferase [*Fusobacterium* sp. D12]<br>>ref|ZP_09528784.1| hypothetical protein HMPREF9466_02817 [*Fusobacterium necrophorum* subsp. *funduliforme* 1_1_36S] >ref|ZP_15946533.1| 4-hydroxybutyrate coenzyme A transferase [*Fusobacterium necrophorum* subsp. *funduliforme* Fnf 1007] >gb|EFS22986.1| 4-hydroxybutyrate coenzyme A transferase [*Fusobacterium* sp. D12] >gb|EHO16876.1| hypothetical protein HMPREF9466_02817 [*Fusobacterium necrophorum* subsp. *funduliforme* 1_1_36S] >gb|EJU18967.1| 4-hydroxybutyrate coenzyme A transferase [*Fusobacterium necrophorum* subsp. *funduliforme* Fnf 1007] | ZP_08691841.1<br>GI:340755139<br>(SEQ ID NO: 317) |
| TDC60] >dbj|BAK25964.1| 4-hydroxybutyrate CoA-transferase [*Porphyromonas gingivalis* TDC60] | YP_004510530.1<br>GI:334147601<br>(SEQ ID NO: 318) |
| 4-hydroxybutyrate CoA-transferase [*Porphyromonas gingivalis* W83]<br>>ref|ZP_14485385.1| 4-hydroxybutyrate coenzyme A transferase [*Porphyromonas gingivalis* W50] >gb|AAQ65864.1| 4-hydroxybutyrate CoA-transferase [*Porphyromonas gingivalis* W83] >gb|EIW94739.1| 4-hydroxybutyrate coenzyme A transferase [*Porphyromonas gingivalis* W50] | NP_904965.1<br>GI:34540486<br>(SEQ ID NO: 319) |
| hypothetical protein CKL_3595 [*Clostridium kluyveri* DSM 555]<br>>ref|YP_002473639.1| hypothetical protein CKR_3174 [*Clostridium kluyveri* NBRC 12016] >gb|EDK35586.1| Cat3 [*Clostridium kluyveri* DSM 555] >dbj|BAH08225.1| hypothetical protein [*Clostridium kluyveri* NBRC 12016] | YP_001396957.1<br>GI:153956192<br>(SEQ ID NO: 320) |
| hypothetical protein HMPREF0402_00217 [*Fusobacterium* sp. 12_1B]<br>>gb|EHO84398.1| hypothetical protein HMPREF0402_00217 [*Fusobacterium* sp. 12_1B] | ZP_09586344.1<br>GI:373495791<br>(SEQ ID NO: 321) |
| 4-hydroxybutyrate:acetyl-CoA transferase [*Fusobacterium* sp. 4_1_13]<br>>ref|ZP_06751042.1| 4-hydroxybutyrate CoA-transferase [*Fusobacterium* sp. 3_1_27] >gb|EEO39496.1| 4-hydroxybutyrate:acetyl-CoA transferase [*Fusobacterium* sp. 4_1_13] >gb|EFG34830.1| 4-hydroxybutyrate CoA-transferase [*Fusobacterium* sp. 3_1_27] | ZP_04572117.1<br>GI:237741636<br>(SEQ ID NO: 322) |
| 4-hydroxybutyrate CoA-transferase [*Clostridium tetani* E88] >gb|AAO35111.1| 4-hydroxybutyrate coenzyme A transferase [*Clostridium tetani* E88] | NP_781174.1<br>GI:28210230<br>(SEQ ID NO: 323) |
| 4-hydroxybutyrate:acetyl-CoA transferase [*Fusobacterium* sp. 3_1_36A2]<br>>gb|EEU32079.1| 4-hydroxybutyrate:acetyl-CoA transferase [*Fusobacterium* sp. 3_1_36A2] | ZP_05550423.1<br>GI:256844965<br>(SEQ ID NO: 324) |
| 4-hydroxybutyrate CoA-transferase [*Filifactor alocis* ATCC 35896] >gb|EFE28990.1| 4-hydroxybutyrate CoA-transferase [*Filifactor alocis* ATCC 35896] | YP_005055048.1<br>GI:374308617<br>(SEQ ID NO: 325) |
| 4-hydroxybutyrate CoA-transferase [Bacteroidetes oral taxon 274 str. F0058]<br>>gb|EFI17642.1| 4-hydroxybutyrate CoA-transferase [Bacteroidetes oral taxon 274 str. F0058] | ZP_06983177.1<br>GI:298373187<br>(SEQ ID NO: 326) |
| 4-hydroxybutyrate coenzyme A transferase [*Clostridium* sp. 7_3_54FAA]<br>>gb|EHF07225.1| 4-hydroxybutyrate coenzyme A transferase [*Clostridium* sp. 7_3_54FAA] | ZP_09046738.1<br>GI:355622639<br>(SEQ ID NO: 327) |
| 4-hydroxybutyrate coenzyme A transferase [*Porphyromonas endodontalis* ATCC 35406] >gb|EEN82972.1| 4-hydroxybutyrate coenzyme A transferase [*Porphyromonas endodontalis* ATCC 35406] | ZP_04389695.1<br>GI:229495971<br>(SEQ ID NO: 328) |
| acetyl-CoA hydrolase/transferase [*Megasphaera elsdenii* DSM 20460]<br>>emb|CCC72564.1| acetyl-CoA hydrolase/transferase [*Megasphaera elsdenii* DSM 20460] | YP_004765391.1<br>GI:348025587<br>(SEQ ID NO: 329) |
| acetyl-CoA hydrolase/transferase [*Desulfatibacillum alkenivorans* AK-01]<br>>gb|ACL02920.1| acetyl-CoA hydrolase/transferase [*Desulfatibacillum alkenivorans* AK-01] | YP_002430388.1<br>GI:218779070<br>(SEQ ID NO: 330) |
| 4-hydroxybutyrate CoA-transferase [*Peptoniphilus indolicus* ATCC 29427]<br>>gb|EGY77354.1| 4-hydroxybutyrate CoA-transferase [*Peptoniphilus indolicus* ATCC 29427] | ZP_08935544.1<br>GI:350566925<br>(SEQ ID NO: 331) |

TABLE 53-continued

Exemplary cat2 sequences.

| Description | Accession No. |
| --- | --- |
| acetyl-CoA hydrolase/transferase [*Desulfitobacterium metallireducens* DSM 15288] >gb\|EHC20214.1\| acetyl-CoA hydrolase/transferase [*Desulfitobacterium metallireducens* DSM 15288] | ZP_08976459.1 GI:354557200 (SEQ ID NO: 332) |
| acetyl-CoA hydrolase/transferase [*Acetonema longum* DSM 6540] >gb\|EGO65184.1\| acetyl-CoA hydrolase/transferase [*Acetonema longum* DSM 6540] | ZP_08623452.1 GI:338811223 (SEQ ID NO: 333) |
| Chain A, The Structure Of A Putative 4-Hydroxybutyrate Coa-Transferase From *Porphyromonas Gingivalis* W83 | 3EH7_A GI:217035437 (SEQ ID NO: 334) |
| acetyl-CoA hydrolase/transferase [*Clostridium symbiosum* WAL-14163] >gb\|EGA95251.1\| acetyl-CoA hydrolase/transferase [*Clostridium symbiosum* WAL-14163] | ZP_08089122.1 GI:323483742 (SEQ ID NO: 335) |
| acetyl-CoA hydrolase/transferase [*Megasphaera* genomosp. type_1 str. 28L] >ref\|ZP_08542966.1\| putative butyryl-CoA:acetate CoA-transferase [*Megasphaera* sp. UPII 199-6] >gb\|EFD94764.1\| acetyl-CoA hydrolase/transferase [*Megasphaera* genomosp. type_1 str. 28L] >gb\|EGL39418.1\| putative butyryl-CoA:acetate CoA-transferase [*Megasphaera* sp. UPII 199-6] | ZP_06559383.1 GI:290967830 (SEQ ID NO: 336) |
| acetyl-CoA hydrolase/transferase [*Syntrophothermus lipocalidus* DSM 12680] >gb\|ADI01448.1\| acetyl-CoA hydrolase/transferase [*Syntrophothermus lipocalidus* DSM 12680] | YP_003702013.1 GI:297616854 (SEQ ID NO: 337) |
| acetyl-CoA hydrolase/transferase [*Clostridium symbiosum* WAL-14673] >gb\|EGB19096.1\| acetyl-CoA hydrolase/transferase [*Clostridium symbiosum* WAL-14673] | ZP_08106938.1 GI:323692709 (SEQ ID NO: 338) |

Table 54 provides exemplary cat2 enzyme variants. Table 54 shows exemplary enzyme variant positions with the corresponding amino acid for a particular position that were identified as providing a desirable activity, including cat2 activity, BDO production, and the like. It is understood that the individual cat2 variants such as those described in Table 54 can be used alone, or can be combined with any other variant amino acid position, as disclosed herein, including 2, 3, 4, 5, 6, 7, 8, 9, 10, greater than 10 and up to all variant amino acid positions to generate additional variants having desirable activities.

TABLE 54

Exemplary cat2 enzyme variants.

| Wild-Type Designation | Wild-Type Sequence | Corresponding Positions and Amino Acid Changes | Exemplary Enzyme Sequence Indicating Corresponding Positions |
|---|---|---|---|
| 4-hydroxybutyrate CoA-transferase [Porphyromonas gingivalis W83] VERSION: NP_906037.1 GI: 34541558 | 1 MQWQELYRQR VCSADEAVVD SLKPGTKVVF GHAAAAPVRF SQAMYRQREK LENITVFHML 61 YFGDAPHLAP EMRSHVPTL NFLEGNSRPA SRDRRVDFIP CHFHEVPELF RQGFFPLDVA 121 VVQVSTPNEE GYCSFGVSCD YTKAAAECAP VVVAEVNKQM PFIGGENLIH ISKLTHIIEV 181 DEPIAEVLPP AISDLELRIG QNCASLIKDG DTLQLGIGGI PDAVLRALEG HKDLGIHTEM 241 FTDGVMRMIR KGIINGKKKT LHPEKVVTSL IFGSKELYDF VNNNPVIECY PVDYINNPDV 301 IGKNDRMVSI NSCLEMDLMG QAASESIGYE QFSGSGQVD FLRGAKRSKG GISIMAFPST 361 AKKGTESRIV PILKEGACVT TGRNEVDYVV TEYGVARLRG ATLRQRAEAL TAIAHPDFRP 421 ALEEEIRRRF E (SEQ ID NO: 188) | 30L, 32G, 34A, 58Q, 108Y, 232R, 312S, 314V, 332Y | 1 MQWQELYRQR VCSADEAVVD SLKPGTKVVL GAAAPVRF SQAMYRQREK LENITVFQML 61 YFGDAPHLAP EMRSHVPTL NFLEGNSRPA SRDRRVDFIP CHFHEVPYLF RQGFFPLDVA 121 VVQVSTPNEE GYCSFGVSCD YTKAAAECAP VVVAEVNKQM PFIGGENLIH ISKLTHIIEV 181 DEPIAEVLPP AISDLELRIG QNCASLIKDG DTLQLGIGGI PDAVLRALEG HRDLGIHTEM 241 FTDGVMRMIR KGIINGKKKT LHPEKVVTSL IFGSKELYDF VNNNPVIECY PVDYINNPDV 301 IGKNDRMVSI NSCVEMDLMG QAASESIGYE QVSGSGQVD FLRGAKRSKG GISIMAFPST 361 AKKGTESRIV PILKEGACVT TGRNEVDYVV TEYGVARLRG ATLRQRAEAL TAIAHPDFRP 421 ALEEEIRRRF E (SEQ ID NO: 199) |
| acetyl-CoA hydrolase/transferase [Roseiflexus castenholzii DSM 13941] Sequence ID: ref\|YP_001433830.1\|Length: 431 | 1 MPRSLTAGRR EMTAEEAVEL IESNHRVYLG GGCGVPIPLL DALVARAPEL RNVEIIHMLT 61 AGEDPTTAPE LAASFRHNAL FIGHNTRRAV NEGRADFTPI FLGEIPKLFR QGILPLDVAM 121 IQVSPPDRHG FCSLGVEVGC TLPAARTAKI VIAEVNARMP RTLGDSFIHI SRLTALVESD 181 RPLLELPQGE TNSVAQAIGR HIAELIPDGA TLQLGIGAIP DAVLSNLHGK RHLGIHTELF 241 SDGVIDLVEA GVIDGELKTI HQGKVVAGFI LGSQRCFDWA HNNAMVEMHP TDYVNDPFVI 301 AQHKNMVAVN SALQVDLTGQ VCADSIGTRL YSGVGGQVDF IRGASRSEGG IPIIAISSTA 361 RDGTISRIVP TLDVGAGVFT SRYDVHFVVT EYGVADLYGR TLAQRARALI NIAHPAFRDQ 421 LTEAAKKLHYI (SEQ ID NO: 189) | 29L, 31G, 33A, 57Q, 107Y, 231R, 311S, 313V, 331Y | 1 MPRSLTAGRR EMTAEEAVEL IESNHRVYLG HCAGVPIPLL DALVARAPEL RNVEIIQMLT 61 AGEDPTTAPE LAASFRHNAL FIGHNTRRAV NEGRADFTPI FLGEIPYLFR QGILPLDVAM 121 IQVSPPDRHG FCSLGVEVGC TLPAARTAKI VIAEVNARMP RTLGDSFIHI SRLTALVESD 181 RPLLELPQGE TNSVAQAIGR HIAELIPDGA TLQLGIGAIP DAVLSNLHGK RHLGIHTELF 241 SDGVIDLVEA GVIDGELKTI HQGKVVAGFI LGSQRCFDWA HNNAMVEMHP TDYVNDPFVI 301 AQHKNMVAVN SAVQVDLTGQ VCADSIGTRL YSGVGGQVDF IRGASRSEGG IPIIAISSTA 361 RDGTISRIVP TLDVGAGVFT SRYDVHFVVT EYGVADLYGR TLAQRARALI NIAHPAFRDQ 421 LTEAAKKLHYI (SEQ ID NO: 200) |

TABLE 54-continued

Exemplary cat2 enzyme variants.

| Wild-Type Designation | Wild-Type Sequence | Corresponding Positions and Amino Acid Changes | Exemplary Enzyme Sequence Indicating Corresponding Positions |
|---|---|---|---|
| hypothetical protein HMPREF0995_05302 [Lachnospiraceae bacterium 7_1_58FAA] Sequence ID: ref\|ZP_09534466.1\|Length: 436 | 1 MNWQEEYKRR LCSAEEAVQH IHSGDTVFLG HAVAESSLLV DAMVQNATAY QDVRIIHMTN 61 LGSGAYTQPG MESHFHVSPF FLGATVRAAV AEGRGDFIPC FFHEIPQLIR ERRVPCDVLM 121 TQVSPSDEKG YCSLGVSADY TYQALKSART VIAHVNDQYP YTFGTKVHVT ELDYIVEQSA 181 PLYESKPPKI GEVEEKIGRC CASLIRDGAT LQLGIGAIPD AVMMFLGDKH DLGIHSEMIS 241 DGTMELYQKG VITNQRKNLD RGKMTITFAM GTKKLYQFLD KNPDVLVKPV DYVNHPVTIM 301 KEHDMISINS AIQVDLQGQV DAEAIGLRQF SGVGGQVDFI RGAAMGGGTS IIAMPSTTQK 361 KDGTLISKIV PFLDQGAPVT TSRNDVDYII TEYGIAHLKG ETLRDRAWAL ISISHPSVRD 421 SLAEEFERRF HQNYRA (SEQ ID NO: 190) | 29L, 31G, 33A, 57Q, 107Y, 230R, 310S, 312V, 330Y | 1 MNWQEEYKRR LCSAEEAVQH IHSGDTVFLG GAAAESSLLV DAMVQNATAY QDVRIIQMTN 61 LGSGAYTQPG MESHFHVSPF FLGATVRAAV AEGRGDFIPC FFHEIPYLIR ERRVPCDVLM 121 TQVSPSDEKG YCSLGVSADY TYQALKSART VIAHVNDQYP YTFGTKVHVT ELDYIVEQSA 181 PLYESKPPKI GEVEEKIGRC CASLIRDGAT LQLGIGAIPD AVMMFLGDKR DLGIHSEMIS 241 DGTMELYQKG VITNQRKNLD RGKMTITFAM GTKKLYQFLD KNPDVLVKPV DYVNHPVTIM 301 KEHDMISINS AVQVDLQGQV DAEAIGLRQY SGVGGQVDFI RGAAMGGGTS IIAMPSTTQK 361 KDGTLISKIV PFLDQGAPVT TSRNDVDYII TEYGIAHLKG ETLRDRAWAL ISISHPSVRD 421 SLAEEFERRF HQNYRA (SEQ ID NO: 201) |
| 4-hydroxybutyrate coenzyme A transferase [Fusobacterium necrophorum subsp. funduliforme ATCC 51357] Sequence ID: ref\|ZP_14365187.1\|Length: 436 | 1 MSKNWREVYK DKIVTADEAV KQIKSGDRLI FSHACGEAQE ITDALLRNKE SYEKVEIIHL 61 VPMGKGEYAQ EENQKYFHN SFFGGGSTRK AINGTYGDFT PSFFFEIPNL FRKNGKLPLD 121 VAIIQVSAPD EHGYCSYGIS CDYTKGAAEN AKIVIAQVNK YMPRTLGENF THLSAIDSIV 181 EYDQPILQLN PPKIGEVEKK IGEYCAGLIQ DGDTLQLGIG AIPDAVLTFL KEKKHLGIHS 241 EMISDGVVDL ILAGVIDNSQ KTIHKNCIV SFLMGSQKLY DYVHNNPGVE LYPVDYVNHP 301 FVIAQNDNMV SINSALQVDL MGQVNAESMG AKQFSGTGGQ VDFVRGAAMS KGGRSIIAMP 361 STAAKGTISK IVMNLDVGAT VTTSRNDVDY IITEYGIAEL KGKTLRERAK ALIAIAHPDF 421 REQLTKQALE KFQRLE (SEQ ID NO: 191) | 31L, 33G, 35A, 59Q, 109Y, 234R, 314S, 316V, 334Y | 1 MSKNWREVYK DKIVTADEAV KQIKSGDRLI LSGAAGEAQE ITDALLRNKE SYEKVEIIQL 61 VPMGKGEYAQ EENQKYFHN SFFGGGSTRK AINGTYGDFT PSFFFEIPYL FRKNGKLPLD 121 VAIIQVSAPD EHGYCSYGIS CDYTKGAAEN AKIVIAQVNK YMPRTLGENF THLSAIDSIV 181 EYDQPILQLN PPKIGEVEKK IGEYCAGLIQ DGDTLQLGIG AIPDAVLTFL KEKRHLGIHS 241 EMISDGVVDL ILAGVIDNSQ KTIHKNCIV SFLMGSQKLY DYVHNNPGVE LYPVDYVNHP 301 FVIAQNDNMV SINSAVQVDL MGQVNAESMG AKQYSGTGGQ VDFVRGAAMS KGGRSIIAMP 361 STAAKGTISK IVMNLDVGAT VTSRNDVDVY IITEYGIAEL KGKTLRERAK ALIAIAHPDF 421 REQLTKQALE KFQRLE (SEQ ID NO: 202) |
| 4-hydroxybutyrate coenzyme A transferase [Clostridium kluyveri DSM 555] | 1 MEWEEIYKEK LVTAEKAVSK IENHSRVVFA HAVGEPVDLV NALVKNKDNY IGLEIVHMVA 61 MGKGVYTKEG MQRHFRHNAL FVGGSTRDAV NSGRAVYTPC FFYEVPSLFK EKRLPVDVAL | 29L, 31G, 33A, 57Q, 107Y, 23IR, 311S, 313V, 331Y | 1 MEWEEIYKEK LVTAEKAVSK IENHSRVVLA GAAGEPVDLV NALVKNKDNY IGLEIVQMVA 61 MGKGVYTKEG MQRHFRHNAL FVGGSTRDAV NSGRAVYTPC FFYEVPYLFK |

TABLE 54-continued

Exemplary cat2 enzyme variants.

| Wild-Type Designation | Wild-Type Sequence | Corresponding Positions and Amino Acid Changes | Exemplary Enzyme Sequence Indicating Corresponding Positions |
|---|---|---|---|
| Sequence ID: gb\|AAA92344.1\|Length: 429 | 121 IQVSEPDKYG YCSFGVSNDY TKPAAESAKL VIAEVNKNMP RTLGDSFIHV SDIDYIVEAS<br>181 HPLLELQPPK LGDVEKAIGE NCASLIEDGA TLQLGIAIP DAVLLFLKNK NLGIHSEMI<br>241 SDGVMELVKA GVINNKKKTL HPGKIVVTFL MGTKKLYDFV NNNPMVETYS VDYVNNPLVI<br>301 MKNDNMVSIN SCVQVDLMGQ VCSESIGLKQ ISGVGGQVDF IRGANLSKGG KAIIAIPSTA<br>361 GKGKVSRITP LLDTGAAVTT SRNEVDYVVT EYGVAHLKGK TLRNRARALI NIAHPKFRES<br>421 LMNEFKKRF (SEQ ID NO: 192) | | EKRLPVDVAL<br>121 IQVSEPDKYG YCSFGVSNDY TKPAAESAKL VIAEVNKNMP RTLGDSFIHV SDIDYIVEAS<br>181 HPLLELQPPK LGDVEKAIGE NCASLIEDGA TLQLGIAIP DAVLLFLKNK RNLGIHSEMI<br>241 SDGVMELVKA GVINNKKKTL HPGKIVVTFL MGTKKLYDFV NNNPMVETYS VDYVNNPLVI<br>301 MKNDNMVSIN SCVQVDLMGQ VCSESIGLKQ YSGVGGQVDF IRGANLSKGG KAIIAIPSTA<br>361 GKGKVSRITP LLDTGAAVTT SRNEVDYVVT EYGVAHLKGK TLRNRARALI NIAHPKFRES<br>421 LMNEFKKRF (SEQ ID NO: 203) |
| 4-Hydroxybutyrate CoA-transferase [Clostridium acetobutyricum] | 1 MDWKKIYEDR TCTADEAVKS IKSGDRVLFA HCVAEPPVLV EAMVANAAAY KNVTVSQMVT<br>61 LGKGEYSKPE YKENFTFEGW FFHEVPSLIR AEGHGQFVPV VYGDTFVHVS EIDKFVETSH<br>121 MVSPPDHNGF CCVGVSSDYT MQAIKSAKIV LAEVNDQVPV VYGDTFVHVS EIDKFVETSH<br>181 PLPEIGLPKI GEVEAAIGKH CASLIEDGST LQLGIAIPD AVLSQLKDKR HLGIHSEMIS<br>241 DGVVDLYEAG VIDCSQKSID KGKMAITFLM GTKRLYDFAA NNPKVELKPV DYINHPSVVA<br>301 QCSKMVCINS CLQVDFMGQI VSDSIGTKQY SGVGGQVDFV RGASMSIDGK GKAIIAMPSV<br>361 AKKKDGSMIS KIVPFIDHGA AVTTSRNDAD YVVTEYGIA MKGKSLQDRA RALINIAHP<br>421 FKDELKAEFE KRFNAAF (SEQ ID NO: 193) | 29L, 31G, 33A, 57Q, 5107Y, 231R, 311S, 313V, 331Y | 1 MDWKKIYEDR TCTADEAVKS IKSGDRVLLA GCAEPPVLV EAMVANAAAY KNVTVSQMVT<br>61 LGKGEYSKPE YKENFTFEGW FFHEVPYLIR AEGHGQFVPV VYGDTFVHVS KDIFHVDFM<br>121 VMVSPPDHNG FCCVGVSSDY TMQAIKSAKI VLAEVNDQVP VVYGDTFVHV SEIDKFVETS<br>181 HPLPEIGLPK IGEVEAAIGK HCASLIEDGS TLQLGIAIP DAVLSQLKDK RHLGIHSEMI<br>241 SDGVVDLYEA GVIDCSQKSI DKGKMAITFL MGTKRLYDFA ANNPKVELKP VDYINHPSVV<br>301 AQCSKMVCIN SCVQVDFMGQ IVSDSIGTKQ YSGVGGQVDF VRGASMSIDG KGKAIIAMPS<br>361 VAKKKDGSMI SKIVPPIDHG AAVTTSRNDA DYVVTEYGIA EMKGKSLQDR ARALINIAHP<br>421 DFKDELKAEF EKRFNAAF (SEQ ID NO: 204) |
| acetyl-CoA hydrolase/transferase [Clostridium beijerinckii NCIMB 8052] Sequence ID: ref\|YP_001309226.1\|Length: 436 | 1 MSKISWKDLY KSKVVTADEA VRKIKSNDRV VTGHACGEPK EIIDAMVRNK DLYENVEIVH<br>61 MVSMGKSEYC KPEMAVNFRH NSIFAGGTTR EAIFDGRADF TPCFFSEVPK MFREGTLPVD<br>121 VALVQLSVPD EHGYCSFGVS NDYTKPAAEA AKIVIAELNE KMPRTLGDSF IHVSDIDYIV<br>181 ETSNDIIELK PKIGEVEKA IGENCAKLIE | 32L, 34G, 36A, 57Q, 110Y, 231R, 314S, 316V, 334Y | 1 MSKISWKDLY KSKVVTADEA VRKIKSNDRV VLGAAGEPK EIIDAMVRNK DLYENVEIVQ<br>61 MVSMGKSEYC KPEMAVNFRH NSIFAGGTTR EAIFDGRADF TPCFFSEVPY MFREGTLPVD<br>121 VALVQLSVPD EHGYCSFGVS |

TABLE 54-continued

Exemplary cat2 enzyme variants.

| Wild-Type Designation | Wild-Type Sequence | Corresponding Positions and Amino Acid Changes | Exemplary Enzyme Sequence Indicating Corresponding Positions |
|---|---|---|---|
| | DGSTLQLGIG AIPDAVLLFL KGKKDLGIHS 241 EMISDGVVEL IEAGVITNKA KTLHPGKSVV TFLMGTKRLY DYVNGNPSVA MYPVDYVNNP 301 CVIAENYKMV SINSCIQVDL MGQVAADTIG LKQFSGVGGQ VDFVRGAAMA KGGKSIIAMP 361 STASKGKLSR IVPILDEGAT VTTSRNDIHY VVTEFGIAEL KGKTLKERAK ALINVAHPDF 421 RDALIKEWEK RFKVKF (SEQ ID NO: 194) | | NDYTKPAAEA AKIVIAELNE KMPRTLGDSF IHVSDIDYIV 181 ETSNDIIELK PPKIGEVEKA IGENCAKLIE DGSTLQLGIG AIPDAVLLFL KGKRDLGIHS 241 EMISDGVVEL IEAGVITNKA̲ KTLHPGKSVV TFLMGTKRLY DYVNGNPSVA MYPVDYVNNP 301 CVIAENYKMV SINSCQVDL MGQVAADTIG LKQYSGVGGQ̲ VDFVRGAAMA KGGKSIIAMP 361 STASKGKLSR IVPILDEGAT VTTSRNDIHY VVTEFGIAEL KGKTLKERAK ALINVAHPDF 421 RDALIKEWEK RFKVKF (SEQ ID NO: 205) |
| 4-hydroxybutyrate CoA-transferase [*Eubacterium saphenum* ATCC 49989] Sequence ID: ref\|ZP_05427217.1\|Length: 438 | 1 MDWKKIYEEK RCTAKEAVQS IKSNDRVVFA HAVAEPTSLV DAMVENKEAY ENVTISHMFS 61 FGKGEYSLPE NSKHFRYEGW FNSPNTRKST ELGHGDYVPA FFHQVPSLIR RGVLPVDVVM 121 VSLSKPDAHG YCSTGVSSDY TMQAIKSAKV VLAEINDQVP KTFGESFVHI SEIDKLVEHS 181 HPLFELGLPK IGEVEEAIGK HCASLIEDGA TLQLGIGAIP DAVLAQLKHK KDLGIHSEMI 241 SDGAVELFEA GVINNSKKSI DKGKMVVTFL MGTKRLYDFV NENPAVELRP VDYVNHPEVI 301 AKSSNLVCIN ACLQVDFMGQ VVSDTIGTRQ FSGVGGQVDF VRGAAMAHDE KAKAIIAMPS 361 VAVKKDGTKI SKIVPFIDHG AAVTTSRHDT DYIVTEYGIA EMVGKTMKDR ARSLINIAHP 421 DFRDELKAEF EKRFNVKF (SEQ ID NO: 195) | 29L, 31G, 33A, 57Q, 107Y, 231R, 311S, 313V, 331Y | 1 MDWKKIYEEK RCTAKEAVQS IKSNDRVVLA GAAEPTSLV DAMVENKEAY ENVTISQMFS̲ 61 FGKGEYSLPE NSKHFRYEGW FNSPNTRKST ELGHGDYVPA FFHQVPYLIR RGVLPVDVVM 121 VSLSKPDAHG YCSTGVSSDY TMQAIKSAKV VLAEINDQVP KTFGESFVHI SEIDKLVEHS 181 HPLFELGLPK IGEVEEAIGK HCASLIEDGA TLQLGIGAIP DAVLAQLKHK RDLGIHSEMI 241 SDGAVELFEA GVINNSKKSI̲ DKGKMVVTFL MGTKRLYDFV NENPAVELRP VDYVNHPEVI 301 AKSSNLVCIN SCLQVDFMGQ VVSDTIGTRQ YSGVG̲GQ̲VDF VRGAAMAHDE KAKAIIAMPS 361 VAVKKDGTKI SKIVPFIDHG AAVTTSRHDT DYIVTEYGIA EMVGKTMKDR ARSLINIAHP 421 DFRDELKAEF EKRFNVKF (SEQ ID NO: 206) |
| 4-hydroxybutyrate coenzyme A transferase [*Clostridium* sp. MSTE9] Sequence ID: ref\|ZP_14663205.1\|Length: 433 | 1 MSWQELYQQK RMTAEQAVSH IKSGDRVVVA HATGEPSALI DAMVKNADAY RNVEIVHMVA 61 MGKGEYCLPE YTENFRHNSL FLGASTRDAI AKGRGDFTPV YFSQIPDLLR EELHPNVALL 121 HLSPPDEHGY CSYGVSVDYT KPAAEIADLR IAQINPNMPR TLGDSFIHVS ELDCIVEVDD 181 PIIELGQAKI AVLLFLKEKK DLGIHSEMPS LQLGIAIPD DGVVELVEAG VITNRRKTLH KGQCVVTFLM 241 GSKRLYDVN NNPSVAMYPV DYVNNPAVIA 301 KDNDLVSINS CIQVDLMGQV VSDTIGPRQF | 29L, 31G, 33A, 57Q, 107Y, 230R, 310S, 312V, 331Y | 1 MSWQELYQQK RMTAEQAVSH IKSGDRVVLA GAAEPSALI DAMVKNADAY RNVEIVQMVA̲ 61 MGKGEYCLPE YTENFRHNSL FLGASTRDAI AKGRGDFTPV YFSQIPYLLR EELHPNVALL 121 HLSPPDEHGY CSYGVSVDYT KPAAEIADLR IAQINPNMPR TLGDSFIHVS ELDCIVEVDD 181 PIIELGQAKI GETECAIGEH CASLIQDGDC AVLLFLKEKR DLGIHSEMFS̲ LQLGIAIPD AVLFLKEKR DLGIHSEMFS |

TABLE 54-continued

Exemplary cat2 enzyme variants.

| Wild-Type Designation | Wild-Type Sequence | Corresponding Positions and Amino Acid Changes | Exemplary Enzyme Sequence Indicating Corresponding Positions |
|---|---|---|---|
| | SGVGGQVDFV RGANLSRGGK SIMAMPSSLV 361 KKDGTRVSKI AVQIDAGAAV TTSRYDVNYI VTEFGVAKLK GKTLRDRAKA LIEIAHPDFR 421 EELMEEFHRR FGV (SEQ ID NO: 196) | | 241 DGVVELVEAG VITNRRKTLH KGQCVVTFLM GSKRLYDYVN NNPSVAMYPV DYVNNPAVIA 301 KNDNLVSINS CVQVDLMGQV VSDSIGPRQY SGVGGQVDFV RGANLSRGGK SIMAMPSSLV 361 KKDGTRVSKI AVQIDAGAAV TTSRYDVNYI VTEFGVAKLK GKTLRDRAKA LIEIAHPDFR 421 EELMEEFHRR FGV (SEQ ID NO: 207) |
| 4-Hydroxybutyrate CoA-transferase [Clostridium aminobutyricum] GenBank: CAB60036.2 | 1 MDWKKIYEDR TCTADEAVKS IKSGDRVLFA HCVAEPPVLV EAMVANAAAY KNVTVSHMVT 61 LGKGEYSKPE YKENFTPEGW FTSPSTRGSI AEGHGQFVPV FFHEVPSLIR KDIFHVDVFM 121 VMVSPPDHNG FCCVGVSSDY TMQAIKSAKI VLAEVNDQVP VVYGDTFVHV SEIDKFVETS 181 HPLPEIGLPK IGEVEAAIGK HCASLIEDGS TLQLGIAIP DAVLSQLKDK KHLGIHSEMI 241 SDGVVDLYEA GVIDCSQKSI DKGKMAITFL MGTKRLYDFA ANNPKVELKP VDYINHPSVV 301 AQCSKMVCIN ACLQVDFMGQ IVSDSIGTKQ FSGVGGQVDF VRGASMSIDG KGKAIIAMPS 361 VAKKKDGSMI SKIVPFIDHG AAVTTSRNDA DYVVTEYGIA EMKGKSLQDR ARALINIAHP 421 DYVVTEYGIA EMKGKSLQDR ARALINIAHP 421 DFKDELKAEF EKRFNAAF (SEQ ID NO: 197) | 29L, 31G, 33A, 57Q, 107Y, 231R, 311S, 313V, 331Y | 1 MDWKKIYEDR TCTADEAVKS IKSGDRVLLA GCAEPPVLV EAMVANAAAY KNVTVSQMVT 61 LGKGEYSKPE YKENFTPEGW FTSPSTRGSI AEGHGQFVPV FFHEVPLIR KDIFHVDVFM 121 VMVSPPDHNG FCCVGVSSDY TMQAIKSAKI VLAEVNDQVP VVYGDTFVHV SEIDKFVETS 181 HPLPEIGLPK IGEVEAAIGK HCASLIEDGS TLQLGIAIP DAVLSQLKDK RHLGIHSEMI 241 SDGVVDLYEA GVIDCSQKSI DKGKMAITFL MGTKRLYDFA ANNPKVELKP VDYINHPSVV 301 AQCSKMVCIN SCVQVDFMGQ IVSDSIGTKQ FSGVGGQVDF VRGASMSIDG KGKAIIAMPS 361 VAKKKDGSMI SKIVPFIDHG AAVTTSRNDA DYVVTEYGIA EMKGKSLQDR ARALINIAHP 421 DFKDELKAEF EKRFNAAF (SEQ ID NO: 208) |
| acetyl-CoA hydrolase/transferase [Clostridium carboxidivorans P7] Sequence ID: ref|ZP_05395303.1|Length: 433 | 1 MDWKKLYKSK LVSAKEAVSN IKSNSRVVVS IAVAEPTELI DALVANKENY ENVEVVHMVD 61 MGKSEYAQEG MEKYFKNSI FVGASTKDAV NSGRSDFTPC CFYELPRLFE EGYLPVDVVL 121 IQVSKPDKHG YCSFGVSNDY TKPAADCAKM VIAEVNENMP RVLGDSFIHI SDIDYIVETS 181 HPIMELKQPK IGKIEEAIGE YCASLIEDGS TLQLGIAIP DAVLLFLKDK KDLGIHSEMI 241 SDGVVDLVES GVINNEKTL NPGKIVVTFF MGTKKLYDFI DDNPMVESYP VSYVNDPTVI 301 MENSKMLSIN SCVEVDLMGQ VCSESIGMNQ ISGIGGQVDF IRGANMCKDG KAIIAIPSTA 361 AKGKVSRIVP LIEKGTPITT SRTDVDYIIT EYGIARLKSK SLKERARALI NIAHPDFRAW | 29L, 31G, 33A, 57Q, 107Y, 231R, 311S, 313V, 331Y | 1 MDWKKLYKSK LVSAKEAVSN IKSNSRVVVS IAAAEPTELI DALVANKENY ENVEVVQMVD 61 MGKSEYAQEG MEKYFKNSI FVGASTKDAV NSGRSDFTPC CFYELPRLFE EGYLPVDVVL 121 IQVSKPDKHG YCSFGVSNDY TKPAADCAKM VIAEVNENMP RVLGDSFIHI SDIDYIVETS 181 HPIMELKQPK IGKIEEAIGE YCASLIEDGS TLQLGIAIP DAVLLFLKDK RDLGIHSEMI 241 SDGVVDLVES GVINNEKTL NPGKIVTFF MGTKKLYDFI DDNPMVESYP VSYVNDPTVI |

TABLE 54-continued

Exemplary cat2 enzyme variants.

| Wild-Type Designation | Wild-Type Sequence | Corresponding Positions and Amino Acid Changes | Exemplary Enzyme Sequence Indicating Corresponding Positions |
|---|---|---|---|
| | 421 LIDEYEKRFK TKF (SEQ ID NO: 198) | | 301 MKNSKMISIN SCVEVDLMGQ VCSESIGMNQ ISGIGGQVDF IRGANMCKDG KAIIAIPSTA 361 AKGKVSRIVP LIEKGTPITT SRTDVDYIIT EYGIARLKSK SLKERARALI NIAHPDFRAW 421 LIDEYEKRFK TKF (SEQ ID NO: 209) |

Exemplary cat2 variants include, but are not limited to, single substitutions, or a combination of one or more of the substitutions, at 29L, 31G, 33A, 57Q, 107Y, 231R, 311S, 313V, 331Y for representative sequence(s) shown in Table 54; 29L, 31G, 33A, 57Q, 107Y, 230R, 310S, 312V, 330Y for representative sequence(s) shown in Table 54; 31L, 33G, 35A, 59Q, 109Y, 234R 314S, 316V, 334Y for representative sequence(s) shown in Table 54; 32L, 34G, 36A, 57Q, 110Y, 231R, 314S, 316V, 334Y for representative sequence(s) shown in Table 54; 29L, 31G, 33A, 57Q, 107Y, 230R, 310S, 312V, 331Y for representative sequence(s) shown in Table 54. Representative combinations include combinations of the single substitutions exemplified in Table 54 as in the corresponding respective sequences, including but not limited to: 314S, 316V; 29L, 33A, 57Q; 231R, 331Y; 57Q, 231R; 57Q, 311S, 57Q, 331Y; 33A, 57Q; 231R, 311S; 311S, 331Y; 231R, 311S, 331Y; 107Y, 231R, 331Y; 57Q, 231R, 311S; 57Q, 311S, 331Y; 57Q, 231R, 311S, 331Y 31G, 33A, 331Y; 33A, 231R, 331Y; 57Q, 231R, 331Y; 31G, 33A, 331Y; 33A, 331Y; 33A, 57Q, 107Y; 107Y, 310S, 312V, 331Y; 57Q, 231S, 311S, F331Y; 29L, 31G, 33A, 57Q, 107Y, 231R 311S, 313V, 331Y 109Y, 234R 314S; 59Q, 109Y, 314S, 316V; 31G, 57Q, and the like. It is readily apparent that these an other combinations can be readily made, used and screened using methods well known in the art and as disclosed herein. Based on methods well known in the art for aligning homologous sequences, as described herein, the corresponding positions for the indicated variant amino acid positions of Table 54 can be readily determined for a homologous cat2 sequence.

Variants of ADH were generated using site-directed mutagenesis and/or saturation mutagenesis and/or error-prone PCR and/or directed evolution. Variants were screened for production of products and/or byproducts such as BDO or ethanol in high-throughput assays or in in vitro assays. Additional variants were generated by random combinations of mutations. An exemplary screening method for ADH activity includes, for example, the above in vivo methods for measuring BDO and/or ethanol production. For in vitro assays, purified enzymes were assayed using 96 well polystyrene plates with 100 µl assay mixture that contained 50 mM Tris, pH 7.4, 150 mM NaCl, 5 mM DTT, 10 mM histidine, 0.3 mM NADPH at varied concentrations of the substrate 4-hydroxybutyraldehyde. The reaction was initiated with addition of purified enzyme and the reduction of NADPH was monitored at 340 nm. Certain enzyme variants exhibited activity of about 1.5-fold, about 2-fold, about 2.5-fold, about 3-fold, about 3.5-fold, about 5-fold, about 6-fold, and about 9-fold higher than wild type. Variants with combinations of two or more variant amino acid positions exhibited activities greater than wild type. Generating enzyme variants by combining active variant amino acid positions resulted in enzyme variants with improved properties.

Table 55 provides exemplary ADH sequences based on homology. One skilled in the art will readily understand that such sequences can be analyzed with routine and well known methods for aligning sequences (for example BLAST, blast.ncbi.nlm.nih.gov; Altschul et al., "*J. Mol. Biol.* 215:403-410 (1990)). Such alignments can provide information on conserved residues that can be utilized to identify a consensus sequence for preserving enzyme activity as well as positions for generating further enzyme variants.

TABLE 55

Exemplary ADH sequences.

| Description | Accession No. |
|---|---|
| NADPH-dependent butanol dehydrogenase [*Clostridium novyi* NT] | YP_878939.1 |
| >gb|ABK62471.1| NADPH-dependent butanol dehydrogenase [*Clostridium novyi* NT] | GI:118444971 (SEQ ID NO: 339) |
| NADPH-dependent butanol dehydrogenase [*Clostridium perfringens* NCTC 8239] | ZP_02642725.2 |
| >gb|EDT78274.1| NADPH-dependent butanol dehydrogenase [*Clostridium perfringens* NCTC 8239] | GI:182420493 (SEQ ID NO: 340) |
| hypothetical protein DORFOR_01493 [*Dorea formicigenerans* ATCC 27755] | ZP_02234621.1 |
| >gb|EDR47002.1| alcohol dehydrogenase, iron-dependent [*Dorea formicigenerans* ATCC 27755] | GI:166031792 (SEQ ID NO: 341) |
| NADPH-dependent butanol dehydrogenase [*Clostridium hathewayi* DSM 13479] | ZP_06115415.1 |
| >gb|EFC98086.1| NADPH-dependent butanol dehydrogenase [*Clostridium hathewayi* DSM 13479] | GI:266622480 (SEQ ID NO: 342) |
| iron-containing alcohol dehydrogenase [*Clostridiales bacterium* 1_7_47_FAA] | ZP_04668388.1 |
| >gb|EEQ59453.1| iron-containing alcohol dehydrogenase [*Clostridiales bacterium* 1_7_47FAA] | GI:239625357 (SEQ ID NO: 343) |
| NADPH-dependent butanol dehydrogenase [*Clostridium celatum* DSM 1785] | ZP_19299687.1 |
| >gb|EKY22101.1| NADPH-dependent butanol dehydrogenase [*Clostridium celatum* DSM 1785] | GI:429767490 (SEQ ID NO: 344) |
| RecName: Full = NADPH-dependent butanol dehydrogenase; Short = BDH | P13604.1 |
| >pir||JU0053 NADPH-dependent butanol dehydrogenase (EC 1.1.1.—) - *Clostridium acetobutylicum* >gb|AAA83520.1| NADPH-dependent butanol dehydrogenase [*Clostridium saccharobutylicum*] | GI:113352 (SEQ ID NO: 345) |
| Alcohol dehydrogenase, class IV [*Ruminococcus bromii* L2-63] >emb|CBL15420.1| | YP_007781197.1 |
| Alcohol dehydrogenase, class IV [*Ruminococcus bromii* L2-63] | GI:479151021 (SEQ ID NO: 346) |
| NADH-dependent butanol dehydrogenase [*Clostridium botulinum* NCTC 2916] | ZP_02614964.1 |
| >gb|EDT80777.1| NADH-dependent butanol dehydrogenase [*Clostridium botulinum* NCTC 2916] | GI:168180300 (SEQ ID NO: 347) |

TABLE 55-continued

Exemplary ADH sequences.

| Description | Accession No. |
|---|---|
| NADPH-dependent butanol dehydrogenase [*Clostridium butyricum* 5521] >ref|ZP_04529706.1| N TABLE 55-continued Exemplary ADH sequences.

| Description | Accession No. |
|---|---|
| NADPH-dependent butanol dehydrogenase [*Clostridium butyricum* 5521] >ref\|ZP_04529712.1\| NADH-dependent butanol dehydrogenase [*Clostridium butyricum* E4 str TABLE 55-continued Exemplary ADH sequences.

| Description | Accession No. |
|---|---|
| NADPH-dependent butanol dehydrogenase [*Clostridium botulinum* B str. Eklund 17B] >gb|ACD23887.1| NADH-dependent butanol dehydrogenase [*Clostridium botulinum* B str. Eklund 17B] | YP_001887401.1<br>GI:187934513<br>(SEQ ID NO: 387) |
| NADH-dependent butanol dehydrogenase, partial [*Clostridium botulinum* CFSAN001627] >gb|EKN42565.1| NADH-dependent butanol dehydrogenase, partial [*Clostridium botulinum* CFSAN001627] | ZP_16269747.1<br>GI:421834809<br>(SEQ ID NO: 388) |
| Alcohol dehydrogenase, class IV [*Ruminococcus torques* L2-14] >emb|CBL26689.1| Alcohol dehydrogenase, class IV [*Ruminococcus torques* L2-14] | YP_007787197.1<br>GI:479157602<br>(SEQ ID NO: 389) |
| iron-containing alcohol dehydrogenase [*Clostridium carboxidivorans* P7] >gb|EET88390.1| iron-containing alcohol dehydrogenase [*Clostridium carboxidivorans* P7] >gb|ADO12118.1| NADH-dependent butanol dehydrogenase [*Clostridium carboxidivorans* P7] | ZP_05391085.1<br>GI:255524125<br>(SEQ ID NO: 390) |
| alcohol dehydrogenase [*Clostridium beijerinckii*] | AAM18709.1<br>GI:20279078<br>(SEQ ID NO: 391) |
| iron-containing alcohol dehydrogenase [*Clostridium carboxidivorans* P7] >gb|EET86647.1| iron-containing alcohol dehydrogenase [*Clostridium carboxidivorans* P7] | ZP_05392917.1<br>GI:255525992<br>(SEQ ID NO: 392) |
| Alcohol dehydrogenase [*Clostridium* sp. DL-VIII] >gb|EHI97343.1| Alcohol dehydrogenase [*Clostridium* sp. DL-VIII] | ZP_09202750.1<br>GI:359410285<br>(SEQ ID NO: 393) |
| hypothetical protein RUMTOR_02695 [*Ruminococcus torques* ATCC 27756] >gb|EDK23148.1| NADPH-dependent butanol dehydrogenase [*Ruminococcus torques* ATCC 27756] | ZP_01969110.1<br>GI:153816442<br>(SEQ ID NO: 394) |
| iron-containing alcohol dehydrogenase [*Clostridium saccharolyticum* WM1] >gb|ADL03437.1| iron-containing alcohol dehydrogenase [*Clostridium saccharolyticum* WM1] | YP_003821060.1<br>GI:302385238<br>(SEQ ID NO: 395) |
| NADPH-dependent butanol dehydrogenase [*Clostridium ljungdahlii* DSM 13528] >gb|ADK17019.1| predicted NADPH-dependent butanol dehydrogenase [*Clostridium ljungdahlii* DSM 13528] | YP_003782121.1<br>GI:300857137<br>(SEQ ID NO: 396) |
| NADPH-dependent butanol dehydrogenase [*Clostridium butyricum* 60E.3] | ENZ30148.1<br>GI:480687146<br>(SEQ ID NO: 397) |
| NADPH-dependent butanol dehydrogenase [*Clostridium perfringens* D str. JGS1721] >gb|EDT73002.1| NADPH-dependent butanol dehydrogenase [*Clostridium perfringens* D str. JGS1721] | ZP_02952006.1.<br>GI:182624220<br>(SEQ ID NO: 398) |
| NADPH-dependent butanol dehydrogenase [*Clostridium perfringens* CPE str. F4969] >gb|EDT27639.1| NADPH-dependent butanol dehydrogenase [*Clostridium perfringens* CPE str. F4969] | ZP_02638669.1<br>GI:168213044<br>(SEQ ID NO: 399) |
| iron-containing alcohol dehydrogenase [*Clostridium beijerinckii* NCIMB 8052] >gb|AAT38119.1| alcohol dehydrogenase [*Clostridium beijerinckii* NCIMB 8052] >gb|ABR34348.1| iron-containing alcohol dehydrogenase [*Clostridium beijerinckii* NCIMB 8052] | YP_001309304.1<br>GI:150017050<br>(SEQ ID NO: 400) |
| NADPH-dependent butanol dehydrogenase Adh [*Clostridium saccharoperbutylacetonicum* N1-4(HMT)] >gb|AGF54256.1| NADPH-dependent butanol dehydrogenase Adh [*Clostridium saccharoperbutylacetonicum* N1-4(HMT)] | YP_007453510.1<br>GI:451817309<br>(SEQ ID NO: 401) |
| hypothetical protein BACCAP_02245 [*Bacteroides capillosus* ATCC 29799] >gb|EDM99972.1| NADPH-dependent butanol dehydrogenase [*Pseudoflavonifractor capillosus* ATCC 29799] | ZP_02036635.1<br>GI:154498257<br>(SEQ ID NO: 402) |
| hypothetical protein RUMLAC_02095 [*Ruminococcus lactaris* ATCC 29176] >gb|EDY31932.1| NADPH-dependent butanol dehydrogenase [*Ruminococcus lactaris* ATCC 29176] | ZP_03168412.1<br>GI:197303373<br>(SEQ ID NO: 403) |
| NADPH-dependent butanol dehydrogenase [*Clostridium clostridioforme* 2_1_49FAA] >gb|EHG29197.1| NADPH-dependent butanol dehydrogenase [*Clostridium clostridioforme* 2_1_49FAA] >gb|ENY86875.1| iron-containing alcohol dehydrogenase [*Clostridium clostridioforme* CM201] >gb|ENZ01519.1| iron-containing alcohol dehydrogenase [*Clostridium clostridioforme* 90B1] >gb|ENZ13590.1| iron-containing alcohol dehydrogenase [*Clostridium clostridioforme* 90A8] >gb|ENZ21103.1| iron-containing alcohol dehydrogenase [*Clostridium clostridioforme* 90A3] >gb|ENZ23413.1| iron-containing alcohol dehydrogenase [*Clostridium clostridioforme* 90A1] >gb|ENZ59818.1| iron-containing alcohol dehydrogenase [*Clostridium clostridioforme* 90A6] >gb|ENZ65377.1| iron-containing alcohol dehydrogenase [*Clostridium clostridioforme* 90A4] | ZP_09116768.1<br>GI:357055705<br>(SEQ ID NO: 404) |
| hypothetical protein CLONEX_01601 [*Clostridium nexile* DSM 1787] >gb|EEA82540.1| hypothetical protein CLONEX_01601 [*Clostridium nexile* DSM 1787] | ZP_03289399.1<br>GI:210612608<br>(SEQ ID NO: 405) |
| NADPH-dependent butanol dehydrogenase [*Clostridium tetani* E88] >gb|AAO36888.1| NADPH-dependent butanol dehydrogenase [*Clostridium tetani* E88] | NP_782951.1<br>GI:28212007<br>(SEQ ID NO: 406) |
| NADH-dependent butanol dehydrogenase [*Clostridium sporogenes* PA 3679] >gb|EHN16013.1| NADH-dependent butanol dehydrogenase [*Clostridium sporogenes* PA 3679] | ZP_18252471.1<br>GI:424827700<br>(SEQ ID NO: 407) |
| iron-containing alcohol dehydrogenase [*Clostridium beijerinckii* NCIMB 8052] >gb|ABR33894.1| iron-containing alcohol dehydrogenase [*Clostridium beijerinckii* NCIMB 8052] | YP_001308850.1<br>GI:150016596<br>(SEQ ID NO: 408) |

TABLE 55-continued

Exemplary ADH sequences.

| Description | Accession No. |
|---|---|
| NADPH-dependent butanol dehydrogenase [*Clostridium botulinum* E3 str. Alaska E43] >gb\|ACD51034.1\| NADH-dependent butanol dehydrogenase [*Clostridium botulinum* E3 str. Alaska E43] | YP_001922335.1<br>GI:150016596<br>(SEQ ID NO: 409) |
| NADH-dependent butanol dehydrogenase [*Clostridium botulinum* B1 str. Okra] >ref\|ZP_19210096.1\| NADH-dependent butanol dehydrogenase [*Clostridium botulinum* CFSAN001628] >gb\|ACA46466.1\| NADH-dependent butanol dehydrogenase [*Clostridium botulinum* B1 str. Okra] >gb\|EKX78737.1\| NADH-dependent butanol dehydrogenase [*Clostridium botulinum* CFSAN001628] | YP_001781276.1<br>GI:170757418<br>(SEQ ID NO: 410) |
| Alcohol dehydrogenase, class IV [butyrate-producing bacterium SS3/4] >emb\|CBL42701.1\| Alcohol dehydrogenase, class IV [butyrate-producing bacterium SS3/4] | YP_007825178.1<br>GI:479195640<br>(SEQ ID NO: 411) |
| hypothetical protein ANACAC_01842 [*Anaerostipes caccae* DSM 14662] >gb\|EDR98218.1\| NADPH-dependent butanol dehydrogenase [*Anaerostipes caccae* DSM 14662] | ZP_02419256.1<br>GI:167747129<br>(SEQ ID NO: 412) |
| NADPH-dependent butanol dehydrogenase [*Clostridium* sp. M62/1] >gb\|EFE12215.1\| NADPH-dependent butanol dehydrogenase [*Clostridium* sp. M62/1] | ZP_06346636.2<br>GI:291087504<br>(SEQ ID NO: 413) |
| Alcohol dehydrogenase, class IV [*Clostridium* cf. *saccharolyticum* K10] >emb\|CBK76115.1\| Alcohol dehydrogenase, class IV [*Clostridium* cf. *saccharolyticum* K10] | YP_007848113.1<br>GI:479336895<br>(SEQ ID NO: 414) |
| hypothetical protein CLOSTASPAR_04682 [*Clostridium asparagiforme* DSM 15981] >gb\|EEG53230.1\| hypothetical protein CLOSTASPAR_04682 [*Clostridium asparagiforme* DSM 15981] | ZP_03760651.1<br>GI:225405462<br>(SEQ ID NO: 415) |
| alcohol dehydrogenase [*Clostridium beijerinckii*] | AAM18705.1<br>GI:20279073<br>(SEQ ID NO: 416) |
| NADPH-dependent butanol dehydrogenase [*Clostridium* sp. D5] >gb\|EGB92190.1\| NADPH-dependent butanol dehydrogenase [*Clostridium* sp. D5] | ZP_08130603.1<br>GI:325263870<br>(SEQ ID NO: 417) |
| iron-containing alcohol dehydrogenase [*Butyrivibrio proteoclasticus* B316] >gb\|ADL34162.1\| iron-containing alcohol dehydrogenase [*Butyrivibrio proteoclasticus* B316] | YP_003830744.1<br>GI:302670784<br>(SEQ ID NO: 418) |
| iron-containing alcohol dehydrogenase [*Clostridium hathewayi* 12489931] | ENY95324.1<br>GI:480651035<br>(SEQ ID NO: 419) |
| NADPH-dependent butanol dehydrogenase [*Dorea formicigenerans* 4_6_53AFAA] >gb\|EGX69980.1\| NADPH-dependent butanol dehydrogenase [*Dorea formicigenerans* 4_6_53AFAA] | ZP_08848505.1<br>GI:346306347<br>(SEQ ID NO: 420) |
| NADPH-dependent butanol dehydrogenase [*Clostridium* sp. 7_2_43FAA] >gb\|EEH97058.1\| NADPH-dependent butanol dehydrogenase [*Clostridium* sp. 7_2_43FAA] | ZP_10977308.1<br>GI:404372007<br>(SEQ ID NO: 421) |
| hypothetical protein HMPREF1006_02359 [*Synergistes* sp. 3_1_syn1] >gb\|EHL70408.1\| hypothetical protein HMPREF1006_02359 [*Synergistes* sp. 3_1_syn1] | ZP_09360726.1<br>GI:365167520<br>(SEQ ID NO: 422) |
| NADH-dependent butanol dehydrogenase [*Clostridium butyricum* DKU-01] 100% | EMU52053.1<br>GI:475994249<br>(SEQ ID NO: 423) |
| NADPH-dependent butanol dehydrogenase [Lachnospiraceae bacterium 9_1_43BFAA] >gb\|EGG88117.1\| NADPH-dependent butanol dehydrogenase [Lachnospiraceae bacterium 9_1_43BFAA] | ZP_08334039.1<br>GI:331084952<br>(SEQ ID NO: 424) |
| NADPH-dependent butanol dehydrogenase [*Clostridium butyricum* 60E.3] | ENZ30152.1<br>GI:480687150<br>(SEQ ID NO: 425) |
| NADPH-dependet butanol dehydrogenase [*Clostridium saccharobutylicum*] | CAQ53139.1<br>GI:188027005<br>(SEQ ID NO: 426) |
| NADPH-dependent butanol dehydrogenase [*Clostridium perfringens* str. 13] >dbj\|BAB80962.1\| NADPH-dependent butanol dehydrogenase [*Clostridium perfringens* str. 13] | NP_562172.1<br>GI:18310238<br>(SEQ ID NO: 427) |
| NADPH-dependent butanol dehydrogenase [*Clostridium botulinum* D str. 1873] >gb\|EES92245.1\| NADPH-dependent butanol dehydrogenase [*Clostridium botulinum* D str. 1873] | ZP_04861753.1<br>GI:253680950<br>(SEQ ID NO: 428) |
| alcohol dehydrogenase [*Clostridium lentocellum* DSM 5427] >gb\|ADZ84386.1\| Alcohol dehydrogenase [*Clostridium lentocellum* DSM 5427] | YP_004309584.1<br>GI:326791763<br>(SEQ ID NO: 429) |
| NADPH-dependent butanol dehydrogenase [*Clostridium botulinum* C str. Eklund] >gb\|EDS78083.1\| NADPH-dependent butanol dehydrogenase [*Clostridium botulinum* C str. Eklund] | ZP_02620674.1<br>GI:168186039<br>(SEQ ID NO: 430) |
| NADPH-dependent butanol dehydrogenase [*Clostridium perfringens* F262] >gb\|EIA17164.1\| NADPH-dependent butanol dehydrogenase [*Clostridium perfringens* F262] | ZP_16920614.1<br>GI:422874129<br>(SEQ ID NO: 431) |
| hypothetical protein CLOSS21_02605 [*Clostridium* sp. SS2/1] >gb\|EDS20969.1\| NADPH-dependent butanol dehydrogenase [*Clostridium* sp. SS2/1] | ZP_02440114.1<br>GI:167768061<br>(SEQ ID NO: 432) |

TABLE 55-continued

Exemplary ADH sequences.

| Description | Accession No. |
|---|---|
| alcohol dehydrogenase, class IV [*Clostridium* sp. Maddingley MBC34-26] >gb|EKQ51809.1| alcohol dehydrogenase, class IV [*Clostridium* sp. Maddingley MBC34-26] | ZP_11366418.1 GI:410728237 (SEQ ID NO: 433) |
| NADPH-dependent butanol dehydrogenase [Lachnospiraceae bacterium 1_4_56FAA] >gb|EGN32435.1| NADPH-dependent butanol dehydrogenase [Lachnospiraceae bacterium 1_4_56FAA] | ZP_08614635.1 GI:336434916 (SEQ ID NO: 434) |
| iron-containing alcohol dehydrogenase [*Clostridium botulinum* BKT015925] >gb|AEB76880.1| iron-containing alcohol dehydrogenase [*Clostridium botulinum* BKT015925] | YP_004396877.1 GI:331270385 (SEQ ID NO: 435) |
| iron-containing alcohol dehydrogenase [*Clostridium clostridioforme* 90A7] >gb|ENZ44225.1| iron-containing alcohol dehydrogenase [*Clostridium bolteae* 90B3] >gb|ENZ49956.1| iron-containing alcohol dehydrogenase [*Clostridium bolteae* 90A9] | ENZ14597.1 GI:480671083 (SEQ ID NO: 436) |
| hypothetical protein DORLON_00585 [*Dorea longicatena* DSM 13814] >gb|EDM63908.1| NADPH-dependent butanol dehydrogenase [*Dorea longicatena* DSM 13814] | ZP_01994600.1 GI:153853191 (SEQ ID NO: 437) |
| iron-containing alcohol dehydrogenase [*Anaerostipes* sp. 3_2_56FAA] >gb|EFV20975.1| iron-containing alcohol dehydrogenase [*Anaerostipes* sp. 3_2_56FAA] | ZP_07932949.1 GI:317473660 (SEQ ID NO: 438) |

Table 56 provides exemplary ADH enzyme variants. Table 56 shows exemplary enzyme variant positions with the corresponding amino acid for a particular position that were identified as providing a desirable activity, including ADH activity, BDO production, and the like. It is understood that the individual ADH variants such as those described in Table 56 can be used alone, or can be combined with any other variant amino acid position, including 2, 3, 4, 5, 6, 7, 8, 9, 10, greater than 10 and up to all variant amino acid positions as disclosed herein, to generate additional variants having desirable activities.

TABLE 56

Exemplary ADH enzyme variants.

| Wild-Type Designation | Wild-Type Sequence | Corresponding Positions and Amino Acid Changes | Exemplary Enzyme Sequence Indicating Corresponding Positions |
|---|---|---|---|
| bifunctional acetaldehyde-CoA/alcohol dehydrogenase [Clostridium acetobutylicum ATCC 824] Sequence ID: ref\|NP_149199.1\|Length: 858 | 1 MKVTNQKELK QKLNELREAQ KKFATYTQEQ VDKIFKQCAI AAAKERINLA KLAVEETGIG 61 LVEDKIIKNH FAAEYIYNKY KNEKTCGIID HDDSLGITKV AEPIGIVAAI VPTTNPTSTA 121 IPKSLISLKT RNAIFSPHP RAKKSTIAAA KLILDAAVKA GAPKNIIGWI DEPSIELSQD 181 LMSEADIILA TGGPSMVKAA YSSGKPAIGV GAGNTPAIID ESADIDMAVS SIILSKTYDN 241 GVICASEQSI LVMNSIYEKV KEEFVKRGSY ILNQNEIAKI KETMFKNGAI NADIVGKSAY 301 IIAKMAGIEV PQTTKILIGE VQSVEKSELF SHEKLSPVLA MYKVKDFDEA LKKAQRLIEL 361 GGSGHTSSLY IDSQNNKDKV KEFGLAMKTS RTFINMPSSQ GASGDLYNFA IAPSFTLGCG 421 TWGGNSVSQN VEPKHLLNIK SVAERRENML WFKVPQKIYF KYGCLRFALK ELKDMNKKRA 481 FIVTDKDLFK LGYVNKITKV LDEIDIKYSI FTDIKSDPTI DSVKKGAKEM LNFEPDTIIS 541 IGGGSPMDAA KVMHLLYEYP EAEIENLAIN FMDIRKRICN FPKLGTKAIS VAIPTTAGTG 601 SEATPFAVIT NDETGMKYPL TSYELTPNMA IIDTELMLNM PRKLTAAVGI DALVHAIEAY 661 VSVMATDYTD ELALRAIKMI FKYLPRAYKN GTNDIEAREK MAHASNIAGM AFANAFLGVC 721 HSMAHKLGAM HHVPHGIACA VLIEEVIKYN ATDCPTKQTA FPQYKSPNAK RKYAEIAEYL 781 NLKGTSDTEK VTALIEAISK LKIDLSIPQN ISAAGINKKD FYNTLDKMSE LAFDDQCTTA 841 NPRYPLISEL KDIYIKSF (SEQ ID NO: 210) | 34H, 35A, 487K (alternative; not shown), 619G, 648V, 648C (alternative; not shown), 653F, 659G (alternative; not shown), 659T, 726Q, 726V (alternative; not shown), 726L (alternative; not shown), 726S (alternative; not shown), 729P, 277T, 837S, 206R, 222H, 127H, 592D, 334L, | 1 MKVTNQKELK QKLNELREAQ KKFATYTQEQ VDKIFKQCAI AAAKERINLA KLAVEETGIG 61 LVEDKIIKNH FAAEYIYNKY KNEKTCGIID HDDSLGITKV AEPIGIVAAI VPTTNPTSTA 121 IPKSLISLKT RNAIFSPHP RAKKSTIAAA KLILDAAVKA GAPKNIIGWI DEPSIELSQD 181 LMSEADIILA TGGPSMVKAA YSSGKPAIGV GAGNTPAIID ESADIDMAVS SIILSKTYDN 241 GVICASEQSI LVMNSIYEKV KEEFVKRGSY ILNQNEIAKI KETMFKNGAI NADIVGKSAY 301 IIAKMAGIEV PQTTKILIGE VQSVEKSELF SHEKLSPVLA MYKVKDFDEA LKKAQRLIEL 361 GGSGHTSSLY IDSQNNKDKV KEFGLAMKTS RTFINMPSSQ GASGDLYNFA IAPSFTLGCG 421 TWGGNSVSQN VEPKHLLNIK SVAERRENML WFKVPQKIYF KYGCLRFALK ELKDMNKKRA 481 FIVTDKDLFK LGYVNKITKV LDEIDIKYSI FTDIKSDPTI DSVKKGAKEM LNFEPDTIIS 541 IGGGSPMDAA KVMHLLYEYP EAEIENLAIN FMDIRKRICN FPKLGTKAIS VDIPTTAGTG 601 SEATPFAVIT NDETGMKYGL TSYELTPNMA IIDTELMLNM PRKLTAAVGI DAFVHAIETY 661 VSVMATDYTD ELALRAIKMI FKYLPRAYKN GTNDIEAREK MAHASNIAGM AFANAFLGVC 721 HSMAHQLGPM HHVPHGIACA VLIEEVIKYN ATDCPTKQTA FPQYKSPNAK RKYAEIAEYL 781 NLKGTSDTEK VTALIEAISK LKIDLSIPQN ISAAGINKKD FYNTLDKMSE LAFDDQSTTA 841 NPRYPLISEL KDIYIKSF (SEQ ID NO: 222) |
| NADPH-dependent butanol dehydrogenase [Clostridium tetani E88] Sequence ID: ref\|NP_782951.1\|Length: 389 | 1 MKRFTIPRDI YYGKGSLEVI KSIKGNKAVI VIGGGSMKRF GFLDKVENYL KEAGIETKLI 61 EGVEPDPSVE TVMKGAEIMR EFKPDWIISI GGGSPIDAAK AWMLFYEHPD LTFEEAAQKV 121 LCLPELRSKA KFMAIPSTSG TASEVTAFSV ITDYKKQIKY PLADFNLTPD IAIVDPELAE 181 TMPAKLTAHT GMDALTHAIE AYVATENTSF TDPLALQAIL MVKDYLIKSY EEDKEARERM 241 HEAQCLAGMA FSNALLGITH SMAHKIGAVF DITHGCANAI FLPYVIQFNS KVCEERYANI 301 AKYLGLEGES DKDLVNSLIN FIRDLNKKLS | 34H, 35A, 35K (alternative; not shown), 161G, 190V, 190C (alternative; not shown), 195F, 201G (alternative; not shown), 201T, 265Q, 265V (alternative; not shown), 265L (alternative; not shown), 265S (alternative; not shown), 268P, 278T, | 1 MKRFTIPRDI YYGKGSLEVI KSIKGNKAVI VIGHASMKRF GFLDKVENYL KEAGIETKLI 61 EGVEPDPSVE TVMKGAEIMR EFKPDWIISI GGGSPIDAAK AWMLFYEHPD LTFEEAAQKV 121 LCLPELRHKA KFMDIPSTSG TASEVTAFSV ITDYKKQIKY GLADFNLTPD IAIVDPELAE 181 TMPAKLTAHV GMDALTHAIE TYVATERTSF TDPLALQAIL MVHDYLIKSY EEDKEARERM 241 HEAQCLAGMA FSNALLGITH SMAHQIGPVF DITHGCATAI FLPYVIQFNS KVCEERYANI |

TABLE 56-continued

Exemplary ADH enzyme variants.

| Wild-Type Designation | Wild-Type Sequence | Corresponding Positions and Amino Acid Changes | Exemplary Enzyme Sequence Indicating Corresponding Positions |
|---|---|---|---|
| | IDNSLKEYGI DENEFKEKVE YMAHNAVLDA 361 CTGANPRKIN EEEMKNMYTY AFNGKDIDF (SEQ ID NO: 211) | 36IS, 207R, 223H, 128H, 134D, 335L, | 301 AKYLGLEGES DKDLVNSLIN FIRDLNKKLS IDNSLKEYGI DENEFKEKVE YMAHNAVLDA 361 CTGANPRKIN EEEMKNMYTY AFNGKDIDF (SEQ ID NO: 223) |
| iron-containing alcohol dehydrogenase [Butyrivibrio proteoclasticus B316] Sequence ID: ref\|YP_003830744.1\|Length: 405 | 1 MSRFTLPRDI YHGKGALEAL KTLEGKRAIV CVGHASMKKG GFLQKVEDYL KEAGMEVELF 61 EGIEPDPSVE TVMKGAEAMQ KFQPDWIVAI GGGSPIDAAK AMWIKYEYPE TTFEDMCKVF 121 GLPKLRTKAH FCAIPSTSGT ATEVTAFSII TDYQKGIKYP IADFEITPDV AIVDPELTHT 181 MPIKLVAHTG MDAMTHAIEA YVSTANCDYT DGLAIHAIEM IQANLVKSYN GDMESRDAMH 241 NAQCLAGMAF DKGAHIIHGA ANAMYLPKVI MAHKTGAVFA DKGAHIIHGA ANAMYLPKVI AFNAKDETAK 301 KRYGVIADYM HLGGSNDDEK VKLLIDYLRK MNDDLNIPHS INHYGADGLP ADQGFVAEDV 361 FLERLHDIAA NAILDACTGS NPRQPSQEEM EKLLKCCYYD TEVDF (SEQ ID NO: 212) | 34H, 35A, 35K (alternative; not shown), 160G, 189V, 189C (alternative; not shown), 194F, 200G (alternative; not shown), 200T, 264Q, 264V 264L (alternative; not shown), 264S (alternative; not shown), 267P, 282T, 377S, 206R, 222H, 127H, 133D, 334L, | 1 MSRFTLPRDI YHGKGALEAL KTLEGKRAIV CVGHASMKKG GFLQKVEDYL KEAGMEVELF 61 EGIEPDPSVE TVMKGAEAMQ KFQPDWIVAI GGGSPIDAAK AMWIKYEYPE TTFEDMCKVF 121 GLPKLRHKAH FCDIPSTSGT ATEVTAFSII TDYQKGIKYG IADFEITPDV AIVDPELTHT 181 MPIKLVAHVG MDAFTHAIET YVSTARCDYT DGLAIHAIEM IHANLVKSYN GDMESRDAMH 241 NAQCLAGMAF SNALLGIVHS MAHQTGPVFA DKGAHIIHGA ATAMYLPKVI AFNAKDETAK 301 KRYGVIADYM HLGGSNDDEK VKLLIDYLRK MNDDLNIPHS LNHYGADGLP ADQGFVAEDV 361 FLERLHDIAA NAILDACTGS NPRQPSQEEM EKLLKCCYYD TEVDF (SEQ ID NO: 224) |
| hypothetical protein ANACAC_01842 [Anaerostipes caccae DSM 14662] Sequence ID: ref\|ZP_02419256.1\| | 1 mgrftlprdl yfgkgsletl ktldgkkavl vlgggsmkrf gfvdqvvdyl keagietkli 61 egvepdpsve tvfkgaevmr dfepdwiiam gggspidaak amwifyehpe ttfddvkdpf 121 tvpplrnkak flaipstsgt atevtafavi tdyssgikyp ladfeitpdi aivdpalaet 181 mppkltsytg mdalthaiea yvaglhspfs dplameaiem vfdnlkasye gdmtarenmh 241 yaqclagmsf snallgivhs lahqtgavfd tghithgcan aiylpyviqf nakvceerya 301 aiarriglpg nsdkaltlsl ieairemnkk lnivsnlkdf gineeefnqk krmiaerava 361 dactgsnpre tsvddmekvl eciyygkdvt f (SEQ ID NO: 213) | 34H, 35A, 35K (alternative; not shown), 160G, 189V, 189C (alternative; not shown), 194F, 200G (alternative; not shown), 200T, 264Q, 264V 264L (alternative; not shown), 264S, 267P, 280T, 363S, 206R, 222H, 127H, A133D, 337L | 1 MGRFTLPRDL YFGKGSLETL KTLDGKKAVL VLGHASMKRF GFVDQVVDYL KEAGIETKLI 61 EGVEPDPSVE TVFKGAEVMR DFEPDWIIAM GGGSPIDAAK AMWIFYEHPE TTFDDVKDPF 121 TVPPLRHKAK FLDIPSTSGT ATEVTAFAVI TDYSSGIKYG LADFEITPDI AIVDPALAET 181 MPPKLTSYVG MDAFTHAIET YVAGLRSPFS DPLAMEAIEM VHDNLKASYE GDMTARENMH 241 YAQCLAGMSF SNALLGIVHS LAHQTGPVFD TGHITHGCAT AIYLPYVIQF NAKVCEERYA 301 AIARRIGLPG NSDKALTLSL IEAIREMNKK LNIVSNLKDF GINEEEFNQK KRMIAERAVA 361 DASTGSNPRE TSVDDMEKVL ECIYYGKDVT F (SEQ ID NO: 225) |
| NADPH-dependent butanol dehydrogenase [Lachnospiraceae bacterium 6_1_63FAA] NCBI Reference Sequence: ZP_08331580.1 | 1 MARFTLPRDL YWGKGSLENL KTLQGKKAVL VLGGGSMKRF GFVDKAVSYL KEAGIETRLF 61 ENVEPDPSVE TVMKGAEFMR EFEPDWIIAM GGGSPIDAAK AMWVFYEYPE CTFEEILTPF 121 SFPELRKKAK FCAIPSTSGT ATEVTAFSVI TDYAKGIKYP LADFNITPDV AIVDPELAET 181 MPKHLVAYTG MDALTHAIEA YVSTLHGTFT DPLALKAIQI VNDELTKSYD GDMASREEMH 241 YGQCLAGMAF SNALLPYVIKY NAKEAEAKKR TGHITHGLAN AMYLPYVIKY EASVDALCNR IVELNNYMGI 301 YETIAAYLGL EASVDALCNR IVELNNYMGI PNTLKEFGIK EDEFKEKISE IAKNAVGDAC | 34H, 35A, 35K (alternative; not shown), 160G, 189V, 189C (alternative; not shown), 194F, 200G (alternative; not shown), 200T, 264Q, 264V (alternative; not shown), 264L, 264S (alternative; not shown), 267P, 280T, 222H, 127H, 360S, 206R, 222H, 127H, | 1 MARFTLPRDL YWGKGSLENL KTLQGKKAVL VLGHASMKRF GFVDKAVSYL KEAGIETRLF 61 ENVEPDPSVE TVMKGAEFMR EFEPDWIIAM GGGSPIDAAK AMWVFYEYPE CTFEEILTPF 121 SFPELRHKAK FCDIPSTSGT ATEVTAFSVI TDYAKGIKYG LADFNITPDV AIVDPELAET 181 MPKHLVAYVG MDALTHAIET YVSTLRGTFT DPLALKAIQI VHDELTKSYD GDMASREEMH 241 YGQCLAGMAF SNALLGIVHS MAHQTGPAFS TGHITHGLAN AMYLPYVIKY NAKEAEAKKR |

TABLE 56-continued

Exemplary ADH enzyme variants.

| Wild-Type Designation | Wild-Type Sequence | Corresponding Positions and Amino Acid Changes | Exemplary Enzyme Sequence Indicating Corresponding Positions |
|---|---|---|---|
| | 361 TGSNPRSIDP ETMEKLFTYI YDGKEVDF (SEQ ID NO: 214) | 133D, 334L | 301 YETIAAYLGL EASVDALCNR IVELNNYMGI PNTLKEFGIK EDEFEKISE IAKNAVGDAS 361 TGSNPRSIDP ETMEKLFTYI YDGKEVDF (SEQ ID NO: 226) |
| NADPH-dependent butanol dehydrogenase [Clostridium celatum DSM 1785] Sequence ID: ref\|ZP_19299687.1\|Length: 388 | 1 MARFTLPRDI YHGNGSLEVL KTLKGKKAVV VVGGGSMKRF GFLEKVENYL KEAGLEVRLI 61 EGVEPDPSVE TVMNGAAVMR EFEPDWIVAM GGGSPIDAAK AMWIFYEYPD FTFEEAVVPF 121 GLPELRQKAK FVAIPSTSGT ATEVTAFSVI TDYKAKIKYP LADFNITPDI AIVDPELAQT 181 MPAKLVAHTG MDALTHAIEA YTASLKSNFS DPLALKAIEM INENLVKSFDN GDKNARDLMH 241 EAQCLAGMAF SNALLGIVHS MAHTGCAVFH IPHGCANAIF LPYVIQYNRS ECEERYADIA 301 KVLKLEGNTN AELTDSLITK INEFNKELNI PATMQEYGVN EEEFLANLKN VAHNAVLDAC 361 TGSNPRTIDD ETMEKLLSCT FYGNKVDF (SEQ ID NO: 215) | 34H, 35A, 35K (alternative; not shown), 160G, 189V, 189C (alternative; not shown), 194F, 200G (alternative; not shown), 200T, 264Q, 264V (alternative; not shown), 264L (alternative; not shown), 264S (alternative; not shown), 267P, 277T, 360S, 206R, 222H, 127H, 133D, 334L, | 1 MARFTLPRDI YHGNGSLEVL KTLKGKKAVV VVGHASMKRF GFLEKVENYL KEAGLEVRLI 61 EGVEPDPSVE TVMNGAAVMR EFEPDWIVAM GGGSPIDAAK AMWIFYEYPD FTFEEAVVPF 121 GLPELRHKAK FVDIPSTSGT ATEVTAFSVI TDYKAKIKYG LADFNITPDI AIVDPELAQT 181 MPAKLVAHVG MDAFTHAIET YTASLRSNFS DPLALKAIEM IHENLVKSFN GDKNARDLMH 241 EAQCLAGMAF SNALLGIVHS MAHQTGCAVFH IPHGCATAIF LPYVIQYNRS ECEERYADIA 301 KVLKLEGNTN AELTDSLITK INEFNKELNI PATLQEYGVN EEEFLANLKN VAHNAVLDAS 361 TGSNPRTIDD ETMEKLLSCT FYGNKVDF (SEQ ID NO: 227) |
| iron-containing alcohol dehydrogenase [Clostridium carboxidivorans P7] NCBI Reference Sequence: ZP_05391085.1 | 1 MSRFTLPRDI YFGENTLETL KTLKGKKAII VVGGGSMKKF GFLQKVEEYL KEAGMEIKLI 61 EGVEPDPSVE TVMKGAEIMR DFEPDWIVSI GGGSPIDAAK AMWIFYEYPE FTFEQAVVPF 121 GIPDLRQKAK FVAIPSTSGT ATEVTAFSVI TDYKAKIKYP LADFNLTPDV AIIDPALAQT 181 MPAKLTAHTG MDALTHAIEA YVAGLRSYFS DPLAMQAIVM TKDNLIKSYE GDKEARDEMH 241 IAQCLAGMAF SNALLGITHS MAHKTGAVFH IPHGCANAIF LPYVIDFNKK TCKDRYATIA 301 KTLGLAGNTD DELVDALTSM IQEMNKKMDI PLNLKEYGVT EEDFNENLDF IAHNAVLDAC 361 TGSNPRPITE EEMKKVFKCT FTGEKVNF (SEQ ID NO: 216) | 34H, 35A, 35K (alternative; not shown), 160G, 189V, 189C (alternative; not shown), 194F, 200G (alternative; not shown), 200T, 264Q, 264V (alternative; not shown), 264L (alternative; not shown), 264S (alternative; not shown), 267P, 277T, 360S, 206R, 222H, 127H, 133D, 334L, | 1 MSRFTLPRDI YFGENTLETL KTLKGKKAII VVGHASMKKF GFLQKVEEYL KEAGMEIKLI 61 EGVEPDPSVE TVMKGAEIMR DFEPDWIVSI GGGSPIDAAK AMWIFYEYPE FTFEQAVVPF 121 GIPDLRHKAK FVDIPSTSGT ATEVTAFSVI TDYKAKIKYG LADFNLTPDV AIIDPALAQT 181 MPAKLTAHVG MDAFTHAIET YVAGLRSYFS DPLAMQAIVM THDNLIKSYE GDKEARDEMH 241 IAQCLAGMAF SNALLGITHS MAHQTGPVFH IPHGCATAIA TCKDRYATIA 301 KTLGLAGNTD DELVDALTSM IQEMNKKMDI PLNLKEYGVT EEDFNENLDF IAHNAVLDAS 361 TGSNPRPITE EEMKKVFKCT FTGEKVNF (SEQ ID NO: 228) |
| NADPH-dependent butanol dehydrogenase [Clostridium butyricum 60E.3]. ACCESSION ENZ30152 VERSION ENZ30152.1 GI: 480687150 | 1 MARFTLPRDI YHGEGSLEVL KTLKGKKAFV VVGGGSMKRF GFLQKVENYL KEAGMEVELF 61 EGVEPDPSVE TVMKGAEAMR KFQPDWIVAM GGGSPIDAAK AMWIFYEYPD FTFEQAVVPF 121 GLPELRQKAK FVAIPSTSGT ATEVTAFSVI TNYTEKIKYP LADFNITPDI AIVDPALAQT 181 MPAKLVAHTG MDALTHAIEA YTASLRSNFS DPLAIKAIEM VNENLVKSFE GDKTARNLMH | 34H, 35A, 35K (alternative; not shown), 160G, 189V, 189C (alternative; not shown), 194F, 200G (alternative; not shown), 200T, 264Q, 264V (alternative; not shown), 264L (alternative; not | 1 MARFTLPRDI YHGEGSLEVL KTLKGKKAFV VVGHASMKRF GFLQKVENYL KEAGMEVELF 61 EGVEPDPSVE TVMKGAEAMR KFQPDWIVAM GGGSPIDAAK AMWIFYEYPD FTFEQAVVPF 121 GLPELRHKAK FVDIPSTSGT ATEVTAFSVI TNYTEKIKYG LADFNITPDI AIVDPALAQT 181 MPAKLVAHVG MDAFTHAIET YTASLRSNFS DPLAIKAIEM VHENLVKSFE GDKTARNLMH |

TABLE 56-continued

Exemplary ADH enzyme variants.

| Wild-Type Designation | Wild-Type Sequence | Corresponding Positions and Amino Acid Changes | Exemplary Enzyme Sequence Indicating Corresponding Positions |
|---|---|---|---|
| iron-containing alcohol dehydrogenase [Clostridium saccharoperbutylacetonicum N1-4 (HMT)] NCBI Reference Sequence: YP_007455800.1 | 241 EAQCLAGMAF SNALLGIVHS MAHKVGAVFH IPHGCANAIF LPYVIKYNRK VCEDRYADIA 301 RALKLEGNTD AELTDSLIKL INEFNDDLSI PHSMKEYGVE EADFKSNVKF IAHNAILDAC 361 TGSSPREIDE ETMEKLFECT YYGTDVNF (SEQ ID NO: 217) | shown), 264S (alternative; not shown), 267P, 277T, 360S, 206R, 222H, 127H, 133D, 334L | 241 EAQCLAGMAF SNALLGIVHS MAHQVGPVFH IPHGCATAIF LPYVIKYNRK VCEDRYADIA 301 RALKLEGNTD AELTDSLIKL INEFNDDLSI PHSLKEYGVE EADFKSNVKF IAHNAILDAS 361 TGSSPREIDE ETMEKLFECT YYGTDVNF (SEQ ID NO: 229) |
| iron-containing alcohol dehydrogenase [Clostridium beijerinckii NCIMB 8052] NCBI Reference Sequence: YP_001309304.1 | 1 MARFTLPRDI YHGEGALEVL KTLKGKKAFV VVGGGSMKRF GFLQKVENYL KEAGMEVELF 61 EGVEPDPSVE TVMKGAEAMR NFEPDWIVSI GGGSPIDAAK AMWIFYEYPD FTFEQAVVPF 121 GLPELRQKAK FVAIPSTSGT ATEVTAFSVI TNYTERIKYP LADFNITPDI AIIDPELAQT 181 MPKTLTAHTG MDALTHAIEA YTASLRSNFS DPLAIKAIEM VNENLFKSYE GDKEARNLMH 241 EAQCLAGMAF SNALLGIVHS MAHKVGAVFH IPHGCANAIF LPYVIQYNRT KCEERYADIA 301 RALKLEGNND AELTDALIAR INKLNEKLSI PSSMKEYGVT EEDFKANLSF IAHNAVLDAC 361 TGSNPREIDD ATMEKLFECT FYGTKVEL (SEQ ID NO: 218) | 34H, 35A, 35K (alternative; not shown), 160G, 189V, 189C (alternative; not shown), 194F, 200G (alternative; not shown), 200T, 264Q, 264V (alternative; not shown), 264L (alternative; not shown), 264S (alternative; not shown), 267P, 277T, 360S, 206R, 222H, 127H, 133D, 334L | 1 MARFTLPRDI YHGEGALEVL KTLKGKKAFV VVGHASMKRF GFLQKVENYL KEAGMEVELF 61 EGVEPDPSVE TVMKGAEAMR NFEPDWIVSI GGGSPIDAAK AMWIFYEYPD FTFEQAVVPF 121 GLPELRHKAK FVDIPSTSGT ATEVTAFSVI TNYTERIKYG LADFNITPDI AIIDPELAQT 181 MPKTLTAHVG MDAFTHAIET YTASLRSNFS DPLAIKAIEM VHENLFKSYE GDKEARNLMH 241 EAQCLAGMAF SNALLGIVHS MAHQVGPVFH IPHGCATAIF LPYVIQYNRT KCEERYADIA 301 RALKLEGNND AELTDALIAR INKLNEKLSI PSSLKEYGVT EEDFKANLSF IAHNAVLDAS 361 TGSNPREIDD ATMEKLFECT FYGTKVEL (SEQ ID NO: 230) |
| iron-containing alcohol dehydrogenase [Clostridium beijerinckii NCIMB 8052] NCBI Reference Sequence: YP_001309304.1 | 1 MARFTLPRDI YHGEGALEAL KTLKGKKAFL VVGGGSMKRF GFLKQVEDYL KEAGMEVELF 61 EGVEPDPSVE TVMKGAEAMR NFEPDWIVAM GGGSPIDAAK AMWIFYEYPD FTFEQAVVPF 121 GLPDLRQKAK FVAIPSTSGT ATEVTAFSVI TNYSEKIKYP LADFNITPDI AIVDPALAQT 181 MPKTLTAHTG MDALTHAIEA YTASLQSNFS DPLAIKAVEM VQENLIKSFE GDKEARNLMH 241 EAQCLAGMAF SNALLGIVHS MAHKVGAVFH IPHGCANAIF LPYVIEYNRT KCENRYGDIA 301 RALKLKGNND AELTDSLIEL INGLNDKLEI PHSMKEYGVT EEDFKANLSF IAHNAVLDAC 361 TGSNPREIDD ATMEKLFECT YYGTKVNL (SEQ ID NO: 219) | 34H, 35A, 35K (Alternative; not shown), 160G, 189V, 189C (Alternative; not shown), 194F, 200G (Alternative; not shown), 200T, 264Q, 264V (Alternative; not shown), 264L (Alternative; not shown), 264S (Alternative; not shown), 267P, 277T, 360S, 206R, 222H, 127H, 133D, 334L | 1 MARFTLPRDI YHGEGALEAL KTLKGKKAFL VVGHASMKRF GFLKQVEDYL KEAGMEVELF 61 EGVEPDPSVE TVMKGAEAMR NFEPDWIVAM GGGSPIDAAK AMWIFYEYPD FTFEQAVVPF 121 GLPDLRHKAK FVDIPSTSGT ATEVTAFSVI TNYSEKIKYG LADFNITPDI AIVDPALAQT 181 MPKTLTAHVG MDAFTHAIET YTASLRSNFS DPLAIKAVEM VHENLIKSFE GDKEARNLMH 241 EAQCLAGMAF SNALLGIVHS MAHQVGPVFH IPHGCATAIF LPYVIEYNRT KCENRYGDIA 301 RALKLKGNND AELTDSLIEL INGLNDKLEI PHSLKEYGVT EEDFKANLSF IAHNAVLDAS 361 TGSNPREIDD ATMEKLFECT YYGTKVNL (SEQ ID NO: 231) |
| hypothetical protein BACCAP_02245 [Bacteroides capillosus ATCC 29799] Sequence ID: ref|ZP_02036635.1| | 1 MSRFTLPRDI YYGANALEAL KTLKGKKAVM VLGGGSMKRF GFVDKAIGYL KEAGIETKLF 61 ENVEPDPSVE TVMKGAAMMR EFEPDWIISM GGGSPIDAAK AMWAFYEYPE TTFEDLITPF 121 NFPELRQKAK FCAIPSTSGT ATEVTAFSVI TDYAKGIKYP LADFNITPDV AIVDPALAET 181 MPPHLVAYTG MDALTHAIEA YVSTLHTVFT | 34H, 35A, 35K (alternative; not shown), 160G, 189V, T189C (alternative; not shown), 194F, 200G (alternative; not shown), 200T, 264Q, 264V (alternative; not | 1 MSRFTLPRDI YYGANALEAL KTLKGKKAVM VLGHASMKRF GFVDKAIGYL KEAGIETKLF 61 ENVEPDPSVE TVMKGAAMMR EFEPDWIISM GGGSPIDAAK AMWAFYEYPE TTFEDLITPF 121 NFPELRHKAK FCDIPSTSGT ATEVTAFSVI TDYAKGIKYG LADFNITPDV AIVDPALAET |

TABLE 56-continued

Exemplary ADH enzyme variants.

| Wild-Type Designation | Wild-Type Sequence | Corresponding Positions and Amino Acid Changes | Exemplary Enzyme Sequence Indicating Corresponding Positions |
|---|---|---|---|
| | DPLAIEAIHI VEKDLIKSFK GDMTCREEMH 241 YGQCLAGMAF SNALLGIVHS MAHKTGAAFS TGHITHGLAN AMYLPYVIAY NSKADGVAER 301 YADIARTMGV VGDTTAELVE GLRAKIRSMN DAMGIPNTLK DFGIIEDEFK EKLEAIATNA 361 VGDACTGSNP RPIDPATMAK LFTCIYYGTE VDF (SEQ ID NO: 220) | shown), 264L (alternative; not shown), 264S (alternative; not shown), 267P, 280T, 360S, 206R, 222H, 127H, 133D, 339L | 181 MPPHLVAYVG MDAFTHAIET YVSTLRTVFT DPLAIEAIHI VHKDLIKSFK GDMTCREEMH 241 YGQCLAGMAF SNALLGIVHS MAHQTGPAFS TGHITHGLAT AMYLPYVIAY NSKADGVAER 301 YADIARTMGV VGDTTAELVE GLRAKIRSMN DAMGIPNTLK DFGIIEDEFK EKLEAIATNA 361 VGDASTGSNP RPIDPATMAK LFTCIYYGTE VDF (SEQ ID NO: 232) |
| NADPH-dependent butanol dehydrogenase [Clostridium perfringens E str. JG51987] Sequence ID: ref\|ZP_02631505.2\|Length: 394 | 1 MGGIISMARF TLPRDIYHGK DSLEVLKSLE GKKAFIVIGG GSMKRFGFLD KVLSYLKEAN 61 METKVFEGVE PDPSVETVMK GAKEMEEFNP DWIVSIGGGS PIDAAKAMWI FYEYPDFTFE 121 KAIVPFGLPK LRRKAKFVAI PSTSGTATEV TAFSVITDYK AKIKYPLADF EITPDIAIVD 181 PSLAETMPEK LVAHTGMDAL THAIEAYTAS LRSNFTDPLA LKAIEMVNMH LVNSFKGDME 241 ARGEMHEAQC LAGMAFSNAL LGIVHSMAHK VGAVFHIPHG CANAIFLPYV IKYNRKACED 301 RYAQIARHIG LKGESERELT DALIDLINKF NKELNIPSSM KEYGIDENEF KTNLKFIAHN 361 AVLDPCTGSN PREIDDETME KLYTCAYYGS DVDF (SEQ ID NO: 221) | 40H, 41A, 41K (alternative; not shown), 166G, 195V, 195C (alternative; not shown), 200F, 206G (alternative; not shown), 206T, 270Q, 270V (alternative; not shown), 270L (alternative; not shown), 270S (alternative; not shown), 273P, 283T, 366S, 212R, 228H, 133H, 139D, 340L | 1 MGGIISMARF TLPRDIYHGK DSLEVLKSLE GKKAFIVIGH ASMKRFGFLD KVLSYLKEAN 61 METKVFEGVE PDPSVETVMK GAKEMEEFNP DWIVSIGGGS PIDAAKAMWI FYEYPDFTFE 121 KAIVPFGLPK LRHKAKFVDI PSTSGTATEV TAFSVITDYK AKIKYGLADF EITPDIAIVD 181 PSLAETMPEK LVAHVGMDAF THAIETYTAS LRSNFTDPLA LKAIEMVHMH LVNSFKGDME 241 ARGEMHEAQC LAGMAFSNAL LGIVHSMAHQ VGPVFHIPHG CAPAIFLPYV IKYNRKACED 301 RYAQIARHIG LKGESERELT DALIDLINKF NKELNIPSSM KEYGIDENEF KTNLKFIAHN 361 AVLDPSTGSN PREIDDETME KLYTCAYYGS DVDF (SEQ ID NO: 233) |

Exemplary ADH variants include, but are not limited to single substitutions, or a combination of one or more of the substitutions, at 34H, 35A, 35K, 161G, 190V, 190C, 190I, 195F, 201G, 201T, 201L, 201F, 265Q, 265V, 265L, 265S, 268P, 278T, 361S, 207R, 223H, 128H, 134D, 335L for representative sequence(s) shown in Table 56; 34H, 35A, 35K, 160G, 189V, 189C, 189A, 194F, A200G, 200T, 200S, 264Q, 264V, 264L, 264S, 267P, 282T, 377S, 206R, 222H, 127H, 133D, 334L for representative sequence(s) shown in Table 56; 34H, 35A, 35K, 160G, 189V, 189C, 194F, 200G, 200T, 264Q, 264V, 264L, 264S, 264A, 267P, 280T, 363S, 206R, 222H, 127H, 133D, 337L for representative sequence (s) shown in Table 56; 34H, 35A, 35K, 160G, 189V, 189C, 194F, 200G, 200T, 264Q, 264V, 264L, 264S, 267P, 280T, 360S, 206R, 222H, 127H, 133D, 334L for representative sequence(s) shown in Table 56; 34H, 35A, 35K, 160G, 189V, 189C, 194F, 200G, 200T, 264Q, 264V, 264L, 264S, 267P, 277T, 360S, 206R, 222H, 127H, 133D, 334L for representative sequence(s) shown in Table 56; 34H, 35A, 35K, 160G, 189V, 189C, 194F, 200G, 200T, 264Q, 264V, 264L, 264S, 267P, 277T, 360S, 206R, 222H, 127H, 133D, 334L for representative sequence(s) shown in Table 56; 34H, 35A, 35K, 160G, 189V, 189C, 194F, 200G, 200T, 264Q, 264V, 264L, 264S, 267P, 277T, 360S, 206R, 222H, 127H, 133D 334L for representative sequence(s) shown in Table 56; 34H, 35A, 35K, 160G, 189V, 189C, 194F, 200G, 200T, 264Q, 264V, 264L, 264S, 267P, 277T, 360S, 206R, 222H, 127H, 133D, 334L for representative sequence(s) shown in Table 56; 34H, 35A, 35K, 160G, 189V, 189C, 194F, 200G, 200T, 264Q, 264V, 264L, 264S, 267P, 277T, 360S, 206R, Q222H, Q127H, A133D, M334L for representative sequence(s) shown in Table 56; 34H, 35A, 35K, 160G, 189V, T189C, 194F, 200G, 200T, 264Q, 264V, 264L, 264S, 267P, 280T, 360S, 206R, 222H, 127H, 133D, 339L for representative sequence(s) shown in Table 56; 40H, 41A, 41K, 166G, 195V, 195C, 200F, 206G, 206T, 270Q, 270V, 270L, 270S, 273P, 283T, 366S, 212R, 228H, 133H, 139D, 340L for representative sequence(s) shown in Table 56. Representative combinations include combinations of the single substitutions exemplified in Table 56 as in the corresponding respective sequences, including but not limited to: 34H, 35A; 34H, 160G; 35A, 160G; 35K, 160G; 133D, 206R, 334L; 267P, 206R, 222H, 127H, 133D; Q222H, A133D, M334L; Q222H, Q127H, A133D, M334L; 200T, 267P; 160G, 189V, 200G, 267P; 160G, 189V, 200T, 267P; 160G, 189C, 200G, 267P; 160G, 189C, 200T, 267P; 160G, 200T; 160G, 267P; 360S, 206R, 222H, 127H; 160G, 189V, 200T, 267P, 360S; 160G, 189C, 200T, 267P, 360S; 160G, 200G, 267P, 277T, 360S, 206R, 222H, 127H, 133D, 334L; 160G, 200T, 267P, 277T, 360S, 206R, 222H, 127H, 133D, 334L; 160G, 200G, 267P, 277T, 360S; 160G, 200T, 267P, 277T, 360S; 160G, 200G, 267P; 160G, 200T, 267P; 360S, 222H, 133D; 360S, 127H, 133D; 127H, 133D; 127H, 133D, 200T; 133D, 200T; 200T, 267P; 194F, 200G, 264Q, 264V; 206R, 222H; 34H, 222H; 35A, 160G, 200T, 267P; 160G, 200T, 267P; 160G, 200G, 267P, 277T, 360S; 160G, 200G, 267P, C360S; 160G, 200G; 160G, 200T; 160G, 267P; 200G, 267P; 200G, 267P, 277T, 360S, 206R, 222H, 127H, 133D, 334L; 200T, 267P, 277T, 360S, 206R, 222H, 127H, 133D, 334L; 200G, 267P, 360S, 206R, 222H, 127H, 133D, 334L; 200T, 267P, 360S, 206R, 222H, 127H, 133D, 334L; 127H, 200T; 200G, 267P, 206R, 222H, 127H, 133D, 334L; 200T, 267, 206R, 222, 127H, 133D, 334L; 200G, 267P, 222H, 127H, 133D, 334L; 200T, 267P, 222H, 127H, 133D, 334L; 200G, 267P, 127H, 133D, 334L; 200T, 267P, 127H, 133D, 334L; 200G, 267P, 334L; 200T, 267P, 334L; 200G, 334L; 200T, 334L; 267P, 334L; 200T, 267P, 334L; 200G, 133D; 200T, 133D; 34H, 35A, 160G, 194F; 34H, 35K, 160G, 194F; 34H, 160G, 189V, 194F; 34H, 160G, 189C, 194F; 34H, 189V, 194F, 200G, 334L; 34H, 189V, 194F, 200T, 334L; 34H, 189C, 194F, 200G, 334L; 34H, 189C, 194F, 200T, 334L; 34H, 194F, 267P, 360S, 334L; 34H, 194F, 267P, 360S; 34H, 264Q, 277T, 360S; 34H, 264V/, 277T, 360S; 34H, 264L, 277T, 360S; 34H, 264S, 277T, 360S; 194F, 200T, 267P, 222H; 34H, 35A, 160G, 189C, 194F, 200T, 264Q, 267P, 277T, 360S; 34H, 35A, 160G, 189V, 194F, 200T, 264V, 267P, 277T, 360S; 34H, 35K, 160G, 189V, 194F, 200T, 264L, 267P, 277T, 360S; G34H, 35K, 160G, 189V, 194F, 200T, 264S, 267P, 277T, 360S; 34H, 35K, 160G, 189V, 194F, 200T, 264Q, 267P, 277T; 34H, 35K, 160G, 189V, 194F, 200T, 264Q, 267P; 35K, 160G, 189V, 194F, 200T, 267P; 160G, 189C, 194F, 200T, 267P; 160G, 189V, 200T, 267P; 34H, G35K, 160G, 189V, 200T, 264Q, 267P, 277T, 360S, 206R; 160G, 189C, 194F, 200T, 264Q, 267P, 360S, 334L; 194F, 264Q; 194F, 264V; 194F, 264L; 194F, 264S; 200G, 360S; 200T, 360S; 200G, 206R; 200T, 206R; 200T, 222H; 200G, 127H, 133D, 334L; 200T, 127H, 133D, 334L; 277T, 360S, 206R, 222H, 127H, 133D, 334L; 360S, 206R, 222H, 127H, 133D, 334L; 206R, 222H, 127H, 133D, 334L; 222H, 127H, 133D, 334L; 127H, 133D, 334L; 133D, 334L; 160G, 133D, 334L; 200G, 277T, 360S, 206R, 222H, 127H, 133D; 200T, 277T, 360S, 206R, 222H, 127H, 133D; 200G, 277T, 360S, 206R, 222H, 127H; 200T, 277T, 360S, 206R, 222H, 127H; 200G, 277T, 360S, 206R, 222H; 200T, 277T, 360S, 206R, 222H; 200G, 277T, 360S, 206R; 200T, 277T, 360S, 206R; 200G, 277T, 360S; 200T, 277T, 360S; 194F, 360S, 334L; 194F, 360S, 206R, 222H, 127H, 133D, 334L; 194F, 200T, 264Q, 264V; 166G, 195C, 200F; 160G, 200T, 267P; 34H, 35A, 223H, 128H; 267P, 360S, 206R; 277T, 360S, 206R; 34H, 35A, 200G; 40H, 195V, 206T, 270V, and the like. It is readily apparent that these an other combinations can be readily made, used and screened using methods well known in the art and as disclosed herein. Based on methods well known in the art for aligning homologous sequences, as described herein, the corresponding positions for the indicated variant amino acid positions of Table 56 can be readily determined for a homologous ADH sequence.

Variants of ALD were generated using site-directed mutagenesis and/or saturation mutagenesis and/or error-prone PCR and/or directed evolution. Variants were screened for production of products and/or byproducts such as BDO or ethanol in high-throughput assays or in in vitro assays as well. Additional variants were generated by random combinations of mutations. At least 179 variants were identified having activity for producing BDO and 4HB, and the variants exhibited production of at least about the same or higher concentrations of 4HB than BDO. At least the same or increased activities were observed in both in vitro and in vivo assays for numerous variants. Certain variants exhibited activity of about 2-fold or greater than the wild type parental enzyme, for example, about 2.5-fold, about 3-fold, about 3.5-fold, about 5-fold, and about 6-fold greater than wild type. Variants with combinations of two or more variant amino acid positions exhibited activities greater than wild type. Generating enzyme variants by combining active variant amino acid positions resulted in enzyme variants with improved properties.

Exemplary screening methods for ALD activity include, for example, the above in vivo methods for measuring BDO and/or ethanol production as well as a 4-hydroxybutyrate (4HB) consumption assay or an in vivo method for measuring BDO, 4-hydroxybutyrate (4HB) and/or gamma-butyrolactone (GBL) production.

The 4-hydroxybutyrate (4HB) consumption assay was performed by 300 µl of M9-MOPS-antibiotic medium containing IPTG (0.2 mM for induction of protein expression) and 4-hydroxybutyrate (50 mM) in a 96-well plate were aseptically inoculated with 6 µl glycerol stock of the clone harboring the plasmid with the aldehyde dehydrogenase gene. A sealing mat was placed on top and the whole plate wrapped in a gas-tight pouch to create a micro-aerobic environment. Cells were then grown under shaking at 30° C. for 20 hours. After measuring the OD of the grown culture, cells were removed by centrifugation and the supernatant used for quantification of the remaining 4HB. To quantify 4HB, an enzymatic reaction was applied in which 4HB is oxidized with NAD+ to succinate semialdehyde using a succinic semialdehyde dehydrogenase. The concentration of remaining 4HB is determined by extrapolation to a standard curve with defined 4HB concentrations. Aldehyde dehydrogenase (Ald) variants were also evaluated for 4-hydroxybutyryl-CoA reductase activity by an enzyme-coupled assay, where the first enzyme is carboxylic acid transferase 2 (Cat2) and the second enzyme is the test Aid variant. Lysates were typically prepared by chemical lysis containing lysozyme, nuclease, 10 mM DTT, and with or without 1 mM coenzyme A. The standard screening assay solution contained 0.1 M Tris-HCl, pH 6.5, 20 mM 4-hydroxybutyric acid, 2 mM acetyl-CoA, 0.25 mM NADH, and 0.25 mM NADPH. Alternatively, the screening assay was conducted without 4HB. The reaction was initiated by the addition of an enzyme lysate that contained both Cat2 and the Aid variant. Initial rate was determined by measuring the linear decrease in cofactor fluorescence (excitation wavelength=360 nm; emission wavelength=465 nm) using a microtiter plate reader.

The in vivo assay for measuring production of BDO, 4-hydroxybutyrate (4HB) and/or gamma-butyrolactone (GBL) was performed by aseptically inoculating a 96 deep well plate with 1 ml of LB+required antibiotic(s) with the colonies of interest. Plates were covered with a gas permeable adhesive seal and incubated overnight (ON) with shaking in a humidified incubator at 37° C. The next day, 100 µl of the ON culture was transferred into a new 96 well plate, containing 1 ml of M9-MOPS-antibiotic medium per well. After a 5-6 hour incubation (as described above), the plate was centrifuged at 4000 rpm for 5 minutes and the supernatant removed. 1.2 ml fresh M9-MOPS-antibiotic was added to each well, and incubated ON as described above. After the incubation, an aliquot of each culture was used to measure OD at 600 nm. The 96 well plate was centrifuged and the supernatants vacuum-filtered with a 96 well plate AcroPrep filter to remove remaining cells. The filtrate was collected and analyzed by LCMS or HPLC.

Table 57 provides exemplary ALD sequences based on homology. One skilled in the art will readily understand that such sequences can be analyzed with routine and well known methods for aligning sequences (for example BLAST, blast.ncbi.nlm.nih.gov; Altschul et al., "*J. Mol. Biol.* 215:403-410 (1990)). Such alignments can provide information on conserved residues that can be utilized to identify a consensus sequence for preserving enzyme activity as well as positions for generating further enzyme variants.

TABLE 57

Exemplary ALD sequences.

| | |
|---|---|
| NAD-dependent aldehyde dehydrogenase [*Clostridium saccharoperbutylacetonicum* N1-4(HMT)] >gb\|AGF59413.1\| NAD-dependent aldehyde dehydrogenase [*Clostridium saccharoperbutylacetonicum* N1-4(HMT)] | YP_007458667.1 GI:451822466 (SEQ ID NO: 439) |
| butyraldehyde dehydrogenase [*Clostridium saccharoperbutylacetonicum* N1-4(HMT)] | AAP42563.1 GI:31075383 (SEQ ID NO: 440) |
| aldehyde dehydrogenase [*Clostridium beijerinckii* NCIMB 8052] >gb\|AAQ12068.1\| coenzyme A acylating aldehyde dehydrogenase [*Clostridium beijerinckii* NCIMB 8052] >gb\|AAQ12072.1\| coenzyme A acylating aldehyde dehydrogenase [*Clostridium beijerinckii*] >gb\|AAT48939.1\| aldehyde dehydrogenase [*Clostridium beijerinckii*] >gb\|AAT66436.1\| coenzyme A-acylating aldehyde dehydrogenase [*Clostridium beijerinckii*] >gb\|ABR35947.1\| aldehyde dehydrogenase [*Clostridium beijerinckii* NCIMB 8052] | YP_001310903.1 GI:150018649 (SEQ ID NO: 441) |
| coenzyme A acylating aldehyde dehydrogenase [*Clostridium beijerinckii*] | AAD31841.1 GI:4884855 (SEQ ID NO: 442) |
| Acetaldehyde dehydrogenase (acetylating) [*Clostridium* sp. DL-VIII] >gb\|EHJ00721.1\| Acetaldehyde dehydrogenase (acetylating) [*Clostridium* sp. DL-VIII] | ZP_09206127.1 GI:359413662 (SEQ ID NO: 443) |
| coenzyme A acylating aldehyde dehydrogenase [*Clostridium saccharobutylicum*] | CAQ57983.1 GI:189310620 (SEQ ID NO: 444) |
| ethanolamine utilization protein EutE [*Clostridium botulinum* B str. Eklund 17B] >gb\|ACD24339.1\| ethanolamine utilization protein EutE [*Clostridium botulinum* B str. Eklund 17B] | YP_001886323.1 GI:187934965 (SEQ ID NO: 445) |
| Aldehyde Dehydrogenase [*Caldalkalibacillus thermarum* TA2.A1] >gb\|EGL82399.1\| Aldehyde Dehydrogenase [*Caldalkalibacillus thermarum* TA2.A1] | ZP_08533507.1 GI:335040377 (SEQ ID NO: 446) |
| Aldehyde Dehydrogenase [*Pelosinus fermentans* DSM 17108] >ref\|ZP_15517111.1\| Aldehyde Dehydrogenase [*Pelosinus fermentans* B4] >ref\|ZP_15521980.1\| Aldehyde Dehydrogenase [*Pelosinus fermentans* B3] >ref\|ZP_15526533.1\| Aldehyde Dehydrogenase [*Pelosinus fermentans* A12] >ref\|ZP_15534416.1\| Aldehyde Dehydrogenase [*Pelosinus fermentans* A11] >gb\|EIW18982.1\| Aldehyde Dehydrogenase [*Pelosinus fermentans* B4] >gb\|EIW21808.1\| Aldehyde Dehydrogenase [*Pelosinus fermentans* A11] >gb\|EIW29163.1\| Aldehyde Dehydrogenase [*Pelosinus fermentans* DSM 17108] >gb\|EIW35484.1\| Aldehyde Dehydrogenase [*Pelosinus fermentans* B3] >gb\|EIW36902.1\| Aldehyde Dehydrogenase [*Pelosinus fermentans* A12] | ZP_10327808.1 GI:392962372 (SEQ ID NO: 447) |
| NAD-dependent aldehyde dehydrogenase [*Thermoanaerobacterium thermosaccharolyticum* M0795] >gb\|AGB19701.1\| NAD-dependent aldehyde dehydrogenase [*Thermoanaerobacterium thermosaccharolyticum* M0795] | YP_007299398.1 GI:433655690 (SEQ ID NO: 448) |
| Aldehyde Dehydrogenase [*Pelosinus fermentans* JBW45] >gb\|EIW48189.1\| Aldehyde Dehydrogenase [*Pelosinus fermentans* JBW45] | ZP_15537951.1 GI:421076976 (SEQ ID NO: 449) |

TABLE 57-continued

Exemplary ALD sequences.

| Description | Accession |
|---|---|
| aldehyde dehydrogenase family protein [*Desulfosporosinus* sp. OT] >gb|EGW35902.1| aldehyde dehydrogenase family protein [*Desulfosporosinus* sp. OT] | ZP_08814704.1 GI:345862484 (SEQ ID NO: 450) |
| hypothetical protein CLOSTMETH_00016 [*Clostridium methylpentosum* DSM 5476] >gb|EEG32278.1| hypothetical protein CLOSTMETH_00016 [*Clostridium methylpentosum* DSM 5476] | ZP_03705305.1 GI:225016072 (SEQ ID NO: 451) |
| aldehyde dehydrogenase [*Thermoanaerobacterium saccharolyticum* JW/SL-YS485] >gb|AFK85255.1| Aldehyde Dehydrogenase [*Thermoanaerobacterium saccharolyticum* JW/SL-YS485] | YP_006390854.1 G: 390933349 (SEQ ID NO: 452) |
| acetaldehyde dehydrogenase [*Thermoanaerobacterium xylanolyticum* LX-11] >gb|AEF18105.1| Acetaldehyde dehydrogenase (acetylating) [*Thermoanaerobacterium xylanolyticum* LX-11] | YP_004471777.1 G: 333897903 (SEQ ID NO: 453) |
| aldehyde dehydrogenase EutE [*Acetonema longum* DSM 6540] >gb|EGO64744.1| aldehyde dehydrogenase EutE [*Acetonema longum* DSM 6540] | ZP_08623980.1 GI:338811775 (SEQ ID NO: 454) |
| ethanolamine utilization protein eutE [*Geobacillus thermoglucosidans* TNO-09.020] >gb|EID44455.1| ethanolamine utilization protein eutE [*Geobacillus thermoglucosidans* TNO-09.020] | ZP_17694107.1 GI:423719925 (SEQ ID NO: 455) |
| aldehyde dehydrogenase [*Geobacillus* sp. Y4.1MC1] >gb|ADP74637.1| Aldehyde Dehydrogenase [*Geobacillus* sp. Y4.1MC1] | YP_003989248.1 GI:312110932 (SEQ ID NO: 456) |
| acetaldehyde dehydrogenase [*Geobacillus thermoglucosidasius* C56-Y593] >gb|AEH47899.1| Acetaldehyde dehydrogenase (acetylating) [*Geobacillus thermoglucosidasius* C56-YS93] | YP_004587980.1 GI:336235364 (SEQ ID NO: 457) |
| aldehyde dehydrogenase EutE [*Bacillus azotoformans* LMG 9581] >gb|EKN64472.1| aldehyde dehydrogenase EutE [*Bacillus azotoformans* LMG 9581] | ZP_11313951.1 GI:410460269 (SEQ ID NO: 458) |
| putative aldehyde dehydrogenase, ethanolamine utilization protein [[*Clostridium*] *sticklandii*] >emb|CBH20800.1| putative aldehyde dehydrogenase, ethanolamine utilization protein [[*Clostridium*] *sticklandii*] | YP_003935705.1 GI:310657984 (SEQ ID NO: 459) |
| Aldehyde Dehydrogenase [*Thermincola potens* JR] >gb|ADG81503.1| Aldehyde Dehydrogenase [*Thermincola potens* JR] | YP_003639404.1 GI:296132157 (SEQ ID NO: 460) |
| CoA-dependent propionaldehyde dehydrogenase [*Clostridium* sp. D5] >gb|EGB92558.1| CoA-dependent propionaldehyde dehydrogenase [*Clostridium* sp. D5] | ZP_08130302.1 GI:325263568 (SEQ ID NO: 461) |
| acetaldehyde dehydrogenase (acetylating) [*Fusobacterium* sp. 3_1_33] >gb|EEW94895.1| acetaldehyde dehydrogenase (acetylating) [*Fusobacterium* sp. 3_1_33] | ZP_05815063.1 GI:260494934 (SEQ ID NO: 462) |
| ethanolamine utilization protein eutE [*Fusobacterium* sp. 7_1] >gb|EEO43449.1| ethanolamine utilization protein eutE [*Fusobacterium* sp. 7_1] | ZP_04573939.1 GI:237743458 (SEQ ID NO: 463) |
| NAD-dependent aldehyde dehydrogenases [*Ruminococcus* sp. SR1/5] >emb|CBL20089.1| NAD-dependent aldehyde dehydrogenases [*Ruminococcus* sp. SR1/5] | YP_007783752.1 GI:479153977 (SEQ ID NO: 464) |
| hypothetical protein HMPREF9942_01197 [*Fusobacterium nucleatum* subsp. *animalis* F0419] >gb|EHO78009.1| hypothetical protein HMPREF9942_01197 [*Fusobacterium nucleatum* subsp. *animalis* F0419] | ZP_17125059.1 GI:423137416 (SEQ ID NO: 465) |
| possible aldehyde dehydrogenase [*Fusobacterium nucleatum* subsp. *polymorphum* ATCC 10953] >gb|EDK87521.1| possible aldehyde dehydrogenase [*Fusobacterium nucleatum* subsp. *polymorphum* ATCC 10953] | ZP_04969437.1 GI:254302079 (SEQ ID NO: 466) |
| ethanolamine utilization protein eutE [*Fusobacterium* sp. D11] >gb|EFD80567.1| ethanolamine utilization protein eutE [*Fusobacterium* sp. D11] | ZP_06524378.1 GI:289765000 (SEQ ID NO: 467) |
| aldehyde dehydrogenase EutE [*Fusobacterium nucleatum* ChDC F128] >gb|EJU08233.1| aldehyde dehydrogenase EutE [*Fusobacterium nucleatum* ChDC F128] | ZP_15972610.1 GI:421526001 (SEQ ID NO: 468) |
| CoA-dependent propionaldehyde dehydrogenase [*Fusobacterium nucleatum* subsp. *polymorphum* F0401] >gb|EHG19190.1| CoA-dependent propionaldehyde dehydrogenase [*Fusobacterium nucleatum* subsp. *polymorphum* F0401] | ZP_16419680.1 GI:422338720 (SEQ ID NO: 469) |
| CoA-dependent propionaldehyde dehydrogenase [*Fusobacterium* sp. 11_3_2] >gb|EGN65750.1| CoA-dependent propionaldehyde dehydrogenase [*Fusobacterium* sp. 11_3_2] | ZP_08600044.1 GI:336419790 (SEQ ID NO: 470) |
| hypothetical protein CLOSTASPAR_02210 [*Clostridium asparagiforme* DSM 15981] >gb|EEG55710.1| hypothetical protein CLOSTASPAR_02210 [*Clostridium asparagiforme* DSM 15981] | ZP_03758198.1 GI:225388474 (SEQ ID NO: 471) |
| aldehyde dehydrogenase [*Clostridium phytofermentans* ISDg] >gb|ABX41556.1| Aldehyde Dehydrogenase_[*Clostridium phytofermentans* ISDg] | YP_001558295.1 GI:160879327 (SEQ ID NO: 472) |
| CoA-dependent propionaldehyde dehydrogenase [*Fusobacterium* sp. 1_1_41FAA] >gb|EFG28139.1| CoA-dependent propionaldehyde dehydrogenase [*Fusobacterium* sp. 1_1_41FAA] | ZP_06748808.1 GI:294783484 (SEQ ID NO: 473) |
| hypothetical protein HMPREF0991_01940 [Lachnospiraceae bacterium 2_1_58FAA] >gb|EGN47419.1| hypothetical protein HMPREF0991_01940 [Lachnospiraceae bacterium 2_1_58FAA] | ZP_08612821.1 GI:336432991 (SEQ ID NO: 474) |
| hypothetical protein RUMGNA_01022 [*Ruminococcus gnavus* ATCC 29149] >gb|EDN78612.1| aldehyde dehydrogenase (NAD) family protein [*Ruminococcus gnavus* ATCC 29149] | ZP_02040258.1 GI:154503198 (SEQ ID NO: 475) |

TABLE 57-continued

Exemplary ALD sequences.

| Description | Accession |
|---|---|
| NAD-dependent aldehyde dehydrogenases [*Ruminococcus obeum* A2-162] >emb\|CBL23217.1\| NAD-dependent aldehyde dehydrogenases [*Ruminococcus obeum* A2-162] | YP_007805199.1 GI:479177598 (SEQ ID NO: 476) |
| aldehyde dehydrogenase [*Clostridium saccharolyticum* WM1] >gb\|ADL04402.1\| Aldehyde Dehydrogenase [*Clostridium saccharolyticum* WM1] | YP_003822025.1 GI:302386203 (SEQ ID NO: 477) |
| aldehyde dehydrogenase family protein [*Flavonifractor plautii* ATCC 29863] >gb\|EHM40040.1\| aldehyde dehydrogenase family protein [*Flavonifractor plautii* ATCC 29863] | ZP_09385796.1 GI:365844997 (SEQ ID NO: 478) |
| hypothetical protein RUMOBE_00094 [*Ruminococcus obeum* ATCC 29174] >gb\|EDM88971.1\| aldehyde dehydrogenase (NAD) family protein [*Ruminococcus obeum* ATCC 29174] | ZP_01962381.1 GI:153809713 (SEQ ID NO: 479) |
| Aldehyde Dehydrogenase [*Clostridium carboxidivorans* P7] >ref\|ZP_06856832.1\| aldehyde dehydrogenase (NAD) family protein [*Clostridium carboxidivorans* P7] >gb\|EET88516.1\| Aldehyde Dehydrogenase [*Clostridium carboxidivorans* P7] >gb\|EFG86154.1\| aldehyde dehydrogenase (NAD) family protein [*Clostridium carboxidivorans* P7] >gb\|ADO12117.1\| CoA-acylating aldehyde dehydrogenase [*Clostridium carboxidivorans* P7] | ZP_05391061.1 GI:255524100 (SEQ ID NO: 480) |
| hypothetical protein FUAG_00592 [*Fusobacterium ulcerans* ATCC 49185] >gb\|EFS25077.1\| hypothetical protein FUAG_00592 [*Fusobacterium ulcerans* ATCC 49185] | ZP_10974295.1 GI:404368948 (SEQ ID NO: 481) |
| hypothetical protein HMPREF0402_00608 [*Fusobacterium* sp. 12_1B] >gb\|EHO83590.1\| hypothetical protein HMPREF0402_00608 [*Fusobacterium* sp. 12_1B] | ZP_09586735.1 GI:373496187 (SEQ ID NO: 482) |
| aldehyde dehydrogenase [*Roseburia inulinivorans* DSM 16841] | ABC25528.1 GI:83596371 (SEQ ID NO: 483) |
| Aldehyde Dehydrogenase [*Clostridium carboxidivorans* P7] >ref\|ZP_06855343.1\| aldehyde dehydrogenase (NAD) family protein [*Clostridium carboxidivorans* P7] >gb\|EET85788.1\| Aldehyde Dehydrogenase [*Clostridium carboxidivorans* P7] >gb\|EFG87815.1\| aldehyde dehydrogenase (NAD) family protein [*Clostridium carboxidivorans* P7] | ZP_05393779.1 GI:255526882 (SEQ ID NO: 484) |
| NAD-dependent aldehyde dehydrogenases [*Clostridium* cf. *saccharolyticum* K10] >emb\|CBK77787.1\| NAD-dependent aldehyde dehydrogenases [*Clostridium* cf. *saccharolyticum* K10] | YP_007849785.1 GI:479338567 (SEQ ID NO: 485) |
| ethanolamine utilization protein eutE [*Fusobacterium varium* ATCC 27725] >gb\|EES62817.1\| ethanolamine utilization protein eutE [*Fusobacterium varium* ATCC 27725] | ZP_08693593.1 GI:340756989 (SEQ ID NO: 486) |
| aldehyde dehydrogenase family protein [*Clostridium celatum* DSM 1785] >gb\|EKY29259.1\| aldehyde dehydrogenase family protein [*Clostridium celatum* DSM 1785] | ZP_19296595.1 GI:429764274 (SEQ ID NO: 487) |
| propionaldehyde dehydrogenase [*Clostridium* sp. ASF502] | EMZ20682.1 GI:476613570 (SEQ ID NO: 488) |
| hypothetical protein HMPREF0988_02063 [*Lachnospiraceae bacterium* 1_4_56FAA] >gb\|EGN36620.1\| hypothetical protein HMPREF0988_02063 [*Lachnospiraceae bacterium* 1_4_56FAA] | ZP_08616478.1 GI:336436768 (SEQ ID NO: 489) |
| hypothetical protein HMPREF0994_03038 [*Lachnospiraceae bacterium* 3_1_57FAA_CT1] >gb\|EGN40215.1\| hypothetical protein HMPREF0994_03038 [*Lachnospiraceae bacterium* 3_1_57FAA_CT1] | ZP_08607032.1 GI:336436768 (SEQ ID NO: 490) |
| aldehyde dehydrogenase [*Ruminococcus* sp. 5_1_39B_FAA] >gb\|EES77009.1\| aldehyde dehydrogenase [*Ruminococcus* sp. 5_1_39BFAA] | ZP_04856816.1 GI:253579547 (SEQ ID NO: 491) |
| CoA-dependent proprionaldehyde dehydrogenase PduP [*Acetobacterium woodii* DSM 1030] >gb\|AFA49334.1\| CoA-dependent proprionaldehyde dehydrogenase PduP [*Acetobacterium woodii* DSM 1030] | YP_005270223.1 GI:379012411 (SEQ ID NO: 492) |
| ethanolamine utilization protein EutE [*Clostridium botulinum* E1 str. 'BoNT E Beluga'] >gb\|EES50221.1\| ethanolamine utilization protein EutE [*Clostridium botulinum* E1 str. 'BoNT E Beluga'] | ZP_04822936.1 GI:251780016 (SEQ ID NO: 493) |
| ethanolamine utilization protein EutE [*Clostridium botulinum* B str. Eklund 17B] >gb\|ACD22415.1\| ethanolamine utilization protein EutE [*Clostridium botulinum* B str. Eklund 17B] | YP_001885942.1 GI:187933041 (SEQ ID NO: 494) |
| ethanolamine utilization protein EutE [*Clostridium botulinum* E3 str. Alaska E43] >gb\|ACD53952.1\| ethanolamine utilization protein EutE [*Clostridium botulinum* E3 str. Alaska E43] | YP_001921227.1 GI:188590535 (SEQ ID NO: 495) |
| propionaldehyde dehydrogenase [*Eubacterium plexicaudatum* ASF492] | EMZ27833.1 GI:476621007 (SEQ ID NO: 496) |
| Aldehyde Dehydrogenase [*Thermosediminibacter oceani* DSM 16646] >gb\|ADL07333.1\| Aldehyde Dehydrogenase [*Thermosediminibacter oceani* DSM 16646] | YP_003824956.1 GI:302389135 (SEQ ID NO: 497) |
| hypothetical protein HMPREF1090_01637 [*Clostridium clostridioforme* 90A8] | ENZ17687.1 GI:480674262 (SEQ ID NO: 498) |
| hypothetical protein HMPREF9467_03550 [*Clostridium clostridioforme* 2_1_49FAA] >gb\|EHG29726.1\| hypothetical protein HMPREF9467_03550 [*Clostridium clostridioforme* 2_1_49FAA] | ZP_09116578.1 GI:357055510 (SEQ ID NO: 499) |
| Aldehyde Dehydrogenase [*Ilyobacter polytropus* DSM 2926] >gb\|ADO84118.1\| Aldehyde Dehydrogenase [*Ilyobacter polytropus* DSM 2926] | YP_003968466.1 GI:310780134 (SEQ ID NO: 500) |

TABLE 57-continued

Exemplary ALD sequences.

| Description | Accession |
|---|---|
| hypothetical protein GCWU000342_00651 [*Shuttleworthia satelles* DSM 14600] >gb|EEP29295.1| hypothetical protein GCWU000342_00651 [*Shuttleworthia satelles* DSM 14600] | ZP_04454656.1<br>GI:229828587<br>(SEQ ID NO: 501) |
| aldehyde dehydrogenase [*Clostridium beijerinckii* NCIMB 8052] >gb|ABR36155.1| aldehyde dehydrogenase [*Clostridium beijerinckii* NCIMB 8052] | YP_001311111.1<br>GI:150018857<br>(SEQ ID NO: 502) |
| propionaldehyde dehydrogenase [*Clostridium clostridioforme* CM201] >gb|ENZ04399.1| propionaldehyde dehydrogenase [*Clostridium clostridioforme* 90B1] >gb|ENZ17257.1| propionaldehyde dehydrogenase [*Clostridium clostridioforme* 90A8] >gb|ENZ22132.1| propionaldehyde dehydrogenase [*Clostridium clostridioforme* 90A3] >gb|ENZ29200.1| propionaldehyde dehydrogenase [*Clostridium clostridioforme* 90A1] >gb|ENZ64224.1| propionaldehyde dehydrogenase [*Clostridium clostridioforme* 90A4] >gb|ENZ70105.1| propionaldehyde dehydrogenase [*Clostridium clostridioforme* 90A6] | ENY83847.1<br>GI:480639338<br>(SEQ ID NO: 503) |
| aldehyde dehydrogenase (NAD) domain protein [*Clostridium* sp. MSTE9] >gb|EJF40077.1| aldehyde dehydrogenase (NAD) domain protein [*Clostridium* sp. MSTE9] | ZP_14663848.1<br>GI:420157008<br>(SEQ ID NO: 504) |
| hypothetical protein CLOBOL_07248 [*Clostridium bolteae* ATCC BAA-613] >gb|EDP12494.1| hypothetical protein CLOBOL_07248 [*Clostridium bolteae* ATCC BAA-613] | ZP_02089671.1<br>GI:160942363<br>(SEQ ID NO: 505) |
| propionaldehyde dehydrogenase [*Clostridium bolteae* 90B8] >gb|ENZ57487.1| propionaldehyde dehydrogenase [*Clostridium bolteae* 90A5] >gb|ENZ67775.1| propionaldehyde dehydrogenase [*Clostridium bolteae* 90B7] | ENZ31577.1<br>GI:480688660<br>(SEQ ID NO: 506) |
| hypothetical protein EUBHAL_00514 [*Eubacterium hallii* DSM 3353] >gb|EEG37590.1| aldehyde dehydrogenase (NAD) family protein [*Eubacterium hallii* DSM 3353] | ZP_03715465.1<br>GI:225026273<br>(SEQ ID NO: 507) |
| CoA-acylating propionaldehyde dehydrogenase [*Halanaerobium saccharolyticum* subsp. *saccharolyticum* DSM 6643] >emb|CCU77919.1| CoA-acylating propionaldehyde dehydrogenase [*Halanaerobium saccharolyticum* subsp. *saccharolyticum* DSM 6643] | ZP_23773859.1<br>GI:470960332<br>(SEQ ID NO: 508) |
| hypothetical protein [*Eubacterium limosum* KIST612] >gb|ADO39014.1| hypothetical protein ELI_4072 [*Eubacterium limosum* KIST612] | YP_003961977.1<br>GI:310829620<br>(SEQ ID NO: 509) |
| aldehyde dehydrogenase [*Thermoanaerobacter* sp. X514] >ref|ZP_07131928.1| Aldehyde Dehydrogenase [*Thermoanaerobacter* sp. X561] >ref|YP_003903905.1| aldehyde dehydrogenase [*Thermoanaerobacter* sp. X513] >ref|ZP_08212082.1| Aldehyde Dehydrogenase [*Thermoanaerobacter ethanolicus* JW 200] >gb|ABY93220.1| aldehyde dehydrogenase [*Thermoanaerobacter* sp. X514] >gb|EFK84693.1| Aldehyde Dehydrogenase [*Thermoanaerobacter* sp. X561] >gb|ADN54614.1| Aldehyde Dehydrogenase [*Thermoanaerobacter* sp. X513] >gb|EGD51928.1| Aldehyde Dehydrogenase [*Thermoanaerobacter ethanolicus* JW 200] | YP_001663556.1<br>GI:167040571<br>(SEQ ID NO: 510) |
| aldehyde dehydrogenase [*Rhodospirillum rubrum* ATCC 11170] >ref|YP_006047210.1| aldehyde dehydrogenase EutE [*Rhodospirillum rubrum* F11] >gb|ABC21715.1| Aldehyde dehydrogenase [*Rhodospirillum rubrum* ATCC 11170] >gb|AEO47413.1| aldehyde dehydrogenase EutE [*Rhodospirillum rubrum* F11] | YP_426002.1<br>GI:83592250<br>(SEQ ID NO: 511) |
| CoA-dependent propionaldehyde dehydrogenase [*Eubacterium yurii* subsp. *margaretiae* ATCC 43715] >gb|EFM39950.1| CoA-dependent propionaldehyde dehydrogenase [*Eubacterium yurii* subsp. *margaretiae* ATCC 43715] | ZP_07453625.1<br>GI:306819974<br>(SEQ ID NO: 512) |
| aldehyde dehydrogenase (NAD) domain protein [*Eubacterium* sp. AS15] >gb|EJP26117.1| aldehyde dehydrogenase (NAD) domain protein [*Eubacterium* sp. AS15] | ZP_10828060.1<br>GI:402309064<br>(SEQ ID NO: 513) |
| aldehyde dehydrogenase EutE [*Vibrio* sp. EJY3] >gb|AEX22176.1| aldehyde dehydrogenase EutE [*Vibrio* sp. EJY3] | YP_005023154.1<br>GI:375265711<br>(SEQ ID NO: 514) |
| hypothetical protein HMPREF9629_00032 [Eubacteriaceae bacterium ACC19a] >gb|EHL16790.1| hypothetical protein HMPREF9629_00032 [Eubacteriaceae bacterium ACC19a] | ZP_09320518.1<br>GI:363893420<br>(SEQ ID NO: 515) |
| aldehyde-alcohol dehydrogenase domain protein [*Propionibacterium propionicum* F0230a] >gb|AFN47240.1| aldehyde-alcohol dehydrogenase domain protein [*Propionibacterium propionicum* F0230a] | YP_006513121.1<br>GI:397671586<br>(SEQ ID NO: 516) |
| hypothetical protein HMPREF9628_01348 [Eubacteriaceae bacterium CM5] >gb|EHL19659.1| hypothetical protein HMPREF9628_01348 [Eubacteriaceae bacterium CM5] | ZP_09316712.1<br>GI:363889349<br>(SEQ ID NO: 517) |
| aldehyde dehydrogenase (NAD) family protein [Eubacteriaceae bacterium OBRC8] >gb|EJU23517.1| aldehyde dehydrogenase (NAD) family protein [Eubacteriaceae bacterium OBRC8] | ZP_10886417.1<br>GI:402837902<br>(SEQ ID NO: 518) |

Table 58 provides exemplary ALD enzyme variants. Table 58 shows exemplary enzyme variant positions with the corresponding amino acid for a particular position that were identified as providing a desirable activity, including ALD activity, BDO production, and the like. It is understood that the individual ALD variants such as those described in Table 58 can be used alone, or can be combined with any other variant amino acid position, including 2, 3, 4, 5, 6, 7, 8, 9, 10, greater than 10 and up to all variant amino acid positions as disclosed herein, to generate additional variants having desirable activities.

TABLE 58

Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| aldehyde dehydrogenase [Clostridium beijerinckii] ACCESSION: AAT48939 VERSION: AAT48939.1 GI: 49036681 | 1 MNKDTLIPTT KDLKVKTNGE NINLKNYKDN SSCFGVFENV ENAISSAVHA QKILSLHYTK 61 EQREKIITEI RKAALQNKEV LATMILEETH MGRYEDKILK HELVAKYTPG TEDLITTAWS 121 GDNGLTVVEM SPYGVIGAIT PSTNPTETVI CNSIGMIAAG NAVVFNGHPC AKKCVAFAVE 181 MINKAIISCG GPENLVTTIK NPTMESLDAI IKHPSIKLLC GTGGPGMVKT LLNSGKKAIG 241 AGAGNPPVIV DDTADIEKAG RSIIEGCSFD NNLPCIAEKE VFVFENVADD LISNMLKNNA 301 VIINEDQVSK LIDLVLQKNN ETQEYFINKK WGKDAKLFL DEIDVESPSN VKCIICEVNA 361 NHPFVMTELM MPILPIVRVK DIDEAIKYAK IAEQNRKHSA YIYSKNIDNL NRFEREIDTT 421 IFVKNAKSFA GVGYEAEGFT TFTIAGSTGE GITSARNFTR QRRCVLAG (SEQ ID NO: 234) | D12L, L15P, D30N, F34K, N42D, I44L, A47T, A47V (ALTERNATIVE; NOT SHOWN), D12L, L15P, D30N, F34K, N42D, I44L, A47T, A47V (ALTERNATIVE; NOT SHOWN), Q51R, Q51K (ALTERNATIVE; NOT SHOWN), L56G, H57A, Y58C, Y58L (ALTERNATIVE; NOT SHOWN), Y58H (ALTERNATIVE; NOT SHOWN), T59G, I66F, I67S, I67A (ALTERNATIVE; NOT SHOWN), R71A, M91R, V104R, K106T, Y107V, D113N, V127I, V128N, E129A, E129Q (ALTERNATIVE; NOT SHOWN), E129A (ALTERNATIVE; NOT SHOWN), E129I, E129Y (ALTERNATIVE; NOT SHOWN), S131W, P132A, Y133V (ALTERNATIVE; NOT SHOWN), V135P, Y133M (ALTERNATIVE; NOT SHOWN), I136A, I139S, I139T (ALTERNATIVE; NOT SHOWN), S142L, M156C, A158V, A159G, V164A, G167P, K172G, F177Y, A178L, K184M, I187K, S188G, E193L, K200M, M204L, M204R, (ALTERNATIVE; NOT SHOWN), D208A, D208L, (ALTERNATIVE; NOT SHOWN), I211C, S215M, S215A (ALTERNATIVE; NOT SHOWN), K217Q, G226R, M227L, M227I (ALTERNATIVE; NOT SHOWN), K229A, T230V, T230R (ALTERNATIVE; NOT SHOWN), T230Q (ALTERNATIVE; NOT SHOWN), L231I, N233Q, N233V (ALTERNATIVE; NOT SHOWN), S234G, S234G (ALTERNATIVE; NOT SHOWN), A241S, G242S, G242D (ALTERNATIVE; NOT SHOWN), A243R, A243N (ALTERNATIVE; NOT SHOWN), A243E (ALTERNATIVE; NOT SHOWN), V248T, D252S, T253F, T253L (ALTERNATIVE; NOT SHOWN), T253A (ALTERNATIVE; NOT SHOWN), K258R, A259T, G260S, G260T (ALTERNATIVE; NOT SHOWN), G260V, G260C (ALTERNATIVE; NOT SHOWN), E265I, E265C (ALTERNATIVE; NOT SHOWN), E265W (ALTERNATIVE; NOT SHOWN), E265V (ALTERNATIVE; NOT SHOWN), G266S, F269L, L273I, L273T (ALTERNATIVE; NOT SHOWN), L273S (ALTERNATIVE; NOT SHOWN), L273M (ALTERNATIVE; NOT SHOWN), L273N (ALTERNATIVE; NOT SHOWN), K279T, E280S, V281L, F284P, A288L, D289K, L291V, N294V, N294D (ALTERNATIVE; NOT SHOWN), M295F, | 1 MNKDTLIPTT KLLKVKTNGE NINLKNYKDN SSCKGVFENV EDALSSTVHA RKILSGACGK 61 EQREKIFSEI AKAALQNKEV LATMILEETH RGRYEDKILK HELRATVTPG TENLITTAWS 121 GDNGLTINAM WAMGPAGAST PLINPTETVI CNSIGCIVGG NAVAFNPHPC AGKCVAYGVE 181 MINMAIKGCG GPLNLVTTIM NPTLESLAAI CKHPMIQLLC GTGGPRLVAV ILQGGKKAIG 241 SSRGNPPTIV DSFADIERTS RSIIISCSLD NNIPCIAETS LFVPENVLKD VISVFLKLNA 301 VIINEDQVSL LIDLVLAKNN ETQEYFKNKK WVADKAKLFL DEIDVESPWN VKNIACEVNE 361 NHPFVMTELL MPILPIVRVK DIYEAIKYAK IAEQPHKFSA MIYSKHIDNL NRFEREIDTT 421 IFVKNAKSFA GVGYEAEGFT TFTIAGSTGE GITSARNFTR QRRCVLAG (SEQ ID NO: 241) |

TABLE 58-continued

Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| ethanolamine utilization protein EutE [Clostridium botulinum B str. Eklund 17B] Sequence ID: ref\|YP_001886323.1\| Length: 467 | 1 MERNLSVLSQ TNDLKITIKRT<br>EGDKSNNKES YLGVFKKVEN<br>AITKAIYAQK KLSLYYTKED<br>61 RERIIKSIRK ATLENKEILA<br>KMIVDETHMG RYEDKILKHE<br>LVAKYTPGTE DLITTAWSGD<br>121 QGLTLVEMSP YGVIGAITP TABLE 58-continued Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| | | E316T (alternative; not shown), I326K, G332A, D348W, C352N, I354A, A359E, M369L, M369H (alternative; not shown), D382Y, R394P, K395H, K395K (alternative; not shown), K395W (alternative; not shown), K395V (alternative; not shown), H397F, Y400M, N405H | |
| aldehyde dehydrogenase [*Clostridium beijerinckii*] ACCESSION: AAT48939 VERSION: AAT48939.1 GI: 49036681 | 1 MNKDTLIPTT KDLKVKTNGE NINLKNYKDN SSCFGVFENV ENAISSAVHA QKILSLHYTK 61 EQREKIITEI RKAALQNKEV LATMILEETH MGRYEDKILK HELVAKYTPG TEDLITTAWS 121 GDNGLTVVEM SPYGVIGAIT PSTNPTETVI CNSIGMIAAG NAVVFNGHPC AKKCVAFAVE 181 MINKAIISCG GPENLVTTIK NPTMESLDAI IKHPSIKLLC GTGGPMWKT LLNSGKKAIG 241 AGAGNPPVIV DDTADIEKAG RSIIEGCSFD NNLPCIAEHE VFVFENVADD LISNMLKNNA 301 VIINEDQVSK LIDLVLQKNN ETQEYFINKK WVGKDAKLFL DEIDVESPSN VKCICEVNA 361 NHPFVMTELM MPILPIVRVK DIDEAIKYAK IAEQNRKHSA YIYSKNIDNL NRFEREIDTT 421 IFVKNAKSFA GVGYEAEGFT TFTIAGSTGE GITSARNFTR QRRCVLAG (SEQ ID NO: 236) | D12L, L15P, D30N, F34K, N42D, I44L, A47L, A47T, A47V (ALTERNATIVE; NOT SHOWN), D12L, L15P, D30N, F34K, N42D, I44L, A47T, A47V (alternative; NOT SHOWN), Q51R, Q51K (ALTERNATIVE; NOT SHOWN), L56G, H57A, Y58C, Y58L (ALTERNATIVE; NOT SHOWN), Y58H (ALTERNATIVE; NOT SHOWN), T59G, I66F, I67S, I67A (ALTERNATIVE; NOT SHOWN), R71A, M91R, V104R, K106T, Y107V, D113N, V127I, V128N, E129A, E129G (ALTERNATIVE; NOT SHOWN), E129A (ALTERNATIVE; NOT SHOWN), E129I, E129Y (ALTERNATIVE; NOT SHOWN), S131W, P132A, (ALTERNATIVE; NOT SHOWN), S131W, P132A, Y133M, Y133V (ALTERNATIVE; NOT SHOWN), Y133N (ALTERNATIVE; NOT SHOWN), V135P, I136A, I139S, I139T (ALTERNATIVE; NOT SHOWN), S142L, M156C, A158V, A159G, V164A, G167P, K172G, F177Y, A178G, K184M, I187K, S188G, E193L, K200M, M204L, M204R (ALTERNATIVE; NOT SHOWN), D208A, D208L (ALTERNATIVE; NOT SHOWN), I211C, S215M, S215A (ALTERNATIVE; NOT SHOWN), K217Q, G226R, M227L, M227I (ALTERNATIVE; NOT SHOWN), K229A, T230V, T230R (ALTERNATIVE; NOT SHOWN), T230Q (ALTERNATIVE; NOT SHOWN), T230V, N233V (ALTERNATIVE; NOT SHOWN), L231I, N233Q, N233V (ALTERNATIVE; NOT SHOWN), S234G, S234G (ALTERNATIVE; NOT SHOWN), A241S, G242S, G242D (ALTERNATIVE; NOT SHOWN), A243R, A243N (ALTERNATIVE; NOT SHOWN), A243E (ALTERNATIVE; NOT SHOWN), V248T, D252S, T253F, T253L (ALTERNATIVE; NOT SHOWN), T253V (ALTERNATIVE; NOT SHOWN), T253A (ALTERNATIVE; NOT SHOWN), K258R, A259T, G260S, G260T (ALTERNATIVE; NOT SHOWN), G260V (ALTERNATIVE; NOT SHOWN), E265I, E265C (ALTERNATIVE; NOT SHOWN), E265N (ALTERNATIVE; NOT SHOWN), E265V (ALTERNATIVE; NOT SHOWN), G266S, F269L, L273I, L273T (ALTERNATIVE; NOT SHOWN), L273S | 1 MNKDTLIPTT KLLKVKTNGE NINLKNYKDN SSCKGVFENV EDALSSTVHA RKILSGACGK 61 EQREKIFSEI AKAALQNKEV LATMILEETH RGRYEDKILK HELRATVTPG TENLITTAWS 121 GDNGLTINAM WAMGPAGAST PLTNPTETVI CNSIGCIVGG NAVAFNPHPC AGKCVAYGVE 181 MINMAIKGCG GPLNLVTTIM NPTLESLAAI CKHPMIQLLC GTGGPRLVAV ILQGGKKAIG 241 SSRGNPPTIV DSFADIERTS RSIIISCSLD NNIPCIAETS LFVPENVLKD VISVFLKLNA 301 VIINEDQVSL LIDLVLAKNN ETQEYFKNKK WVAKDAKLFL DEIDVESPWN VKNIACEVNE 361 NHPFVMTELL MPILPIVRVK DIYEAIKYAK IAEQPHKFSA MIYSKHIDNL NRFEREIDTT 421 IFVKNAKSFA GVGYEAEGFT TFTIAGSTGE GITSARNFTR QRRCVLAG (SEQ ID NO: 243) |

TABLE 58-continued

Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| | | (ALTERNATIVE; NOT SHOWN), L273M | |
| | | (ALTERNATIVE; NOT SHOWN), L273M | |
| | | (ALTERNATIVE; NOT SHOWN), K279T, E280S, | |
| | | V281L, F284P, A288L, D289K, L291V, N294V, | |
| | | N294D (ALTERNATIVE; NOT SHOWN), M295F, | |
| | | N298L, K310L, K310P (ALTERNATIVE; NOT | |
| | | SHOWN), Q317A, Q317T (ALTERNATIVE; NOT | |
| | | SHOWN), I327K, G333A, S349W, C353N, I355A, | |
| | | A360E, M370L, M370H (ALTERNATIVE; NOT | |
| | | SHOWN), D383Y, N395P, R396H, R396K | |
| | | (ALTERNATIVE; NOT SHOWN), R396W | |
| | | (ALTERNATIVE; NOT SHOWN), R396W | |
| | | (ALTERNATIVE; NOT SHOWN), H398F, Y401M, | |
| | | N406H | |
| AD-dependent aldehyde dehydrogenase [Clostridium saccharoperbutylacetonicum N1-4 (HMT)] Sequence ID: ref\|YP_007458667.1\| Length: 468 | 1 MIKDTLVSIT KDLKLKTNVE NANLKNYKDD SSCFGVFENV ENAISNAVHA QKILSLHYTK 61 EQREKIITEI RKAALENKEI LATMLEETH MGRYEDKILK HELVAKYTPG TEDLITTAWS 121 GDNGLTVVEM SPYGVIGAIT PSTNPTETVI CNSIGMIAAG NTVVFNGHPG AKKCVAFAVE 181 MINKAISCG GPENLVTTIK NPTMDSLDAI IKHPSIKLLC GTGGPGMVKT LLNSGKKAIG 241 AGAGNPPVIV DDTADIEKAG KSIIEGCSFD NNLPCIAEKE VFVFENVADD LISNMLKNNA 301 VIINEDQVSK LIDLVLQKNN ETQEYSINKK WVGKDAKLFL DEIDVESPSS VKCIICEVSA 361 SHPFVMTELM MPILPIVRVK DIDEAIEYAK IAEQNRKHSA YIYSKNIDNL NRFEREIDTT 421 IFVKNAKSFA GVGYEAEGFT TFTIAGSTGE GITSARNFTR QRRCVLAG (SEQ ID NO: 237) | D12L, L15P, D30N, F34K, N42D, I44L, A47T, A47V (alternative; not shown), Q51R, Q51K Y58L (alternative; not shown), L56G, H57A, Y58C, Y58L (alternative; not shown), Y58H (alternative; not shown), Y58L (alternative; not shown), T59G, I66F, I67S, I67A (alternative; not shown), R71A, M91R, V104R, K106T, Y107V, D113N, V127I, V128N, E129A, E129G (alternative; not shown), E129Y (alternative; not shown), E129I (alternative; not shown), S131W, P132A, Y133M, Y133V (alternative; not shown), Y133M (alternative; not shown), V135P, I136A, I139S, I139T (alternative; not shown), S142L, M156C, A158V, A159G, V164A, G167P, K172G, F177Y, A178G, K184M, I187K, S188G, E193L, K200M, M204L, M204R (alternative; not shown), I211C, D208A, D208L (alternative; not shown), K217Q, S215M, S215A (alternative; not shown), M227I (alternative; not shown), G226R, M227L, M227I (alternative; not shown), K229A, T230V, T230R (alternative; not shown), T230Q (alternative; not shown), T230V (alternative; not shown), L231I, N233Q, N233V (alternative; not shown), S234G, S241S, A241S (alternative; not shown), G242S, G242D, A243N (alternative; not shown), A243R, A243N (alternative; not shown), A243E (alternative; not shown), V248T, D252S, T253F, T253V (alternative; not shown), T253A (alternative; not shown), T253L (alternative; not shown), K258R, A259T, G260S, G260T (alternative; not shown), G260V (alternative; not shown), G260V G260C (alternative; not shown), E265I, E265C (alternative; not shown), E265W (alternative; | 1 MIKDTLVSIT KLLKPKTNVE NANLKNYKDN SSCKGVFENV EDALSNTVHA RKILSGACGK 61 EQREKFSTEI AKAALENKEI LATMLEETH RGRYEDKILK HELRATVTPG TENLTTTAWS 121 GDNGLTINAM WAMGPAGAST PLTNPTETVI CNSIGCIVGG NTVAFNPHPG AGKCVAYGVE 181 MINMAIKGCG GPLNLVTTIM NPTLDSLAAI CKHPMIQLLC GTGGPRLVAV ILQGGKKAIG 241 SSRGNPPTIV DSFADIERTG KSIIISCSLD NNIPCIAETS LFVPENVLKD VISVFLKLNA 301 VIINEDQVSL LIDLVLAKNN ETQEYSKNKK WVAKDAKLFL DEIDVESPWS VKCIACEVSE 361 SHPFVMTELL MPILPIVRK DIYEAIEYAK IAERPHKFSA MIYSKHIDNL WRFERGADST 421 IFVKNGLSLA GVGYEAPGFT SFTIAVPTGE GMTSAANFTR QRRTVNAN (SEQ ID NO: 244) |

TABLE 58-continued

Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| | | not shown), E265V (alternative; not shown), G266S, F269L, L273I, L273T, L273S (alternative; not shown), L273M (alternative; not shown), L273T (alternative; not shown), L273N (alternative; not shown), K279T, E280S, V281L, F284P, A288L, D289K, L291V, N294V, N294D (alternative; not shown), M295F, N298L, K310L, K310P (alternative; not shown), Q317A, Q317T (alternative; not shown), I327K, G333A, S349W, C353N, I355A, A360E, M370L, M370H (alternative; not shown), D383Y, N395P, R396H, R396K (alternative; not shown), R396W (alternative; not shown), R396V (alternative; not shown), H398F, Y401M, N406H | |
| Aldehyde Dehydrogenase [Pelosinus fermentans JBW45] Sequence ID: ref\|ZP_15537951.1\| Length: 480 | 1 MSIDQALIEK ITLEILTKMQ TGAKAAPAGY GDGIFETVDE AVAAARKAYQ ELKTLSLEKR 61 EVLIKAMRDV AYENATILAQ MAVDESGMGR VSDKIIKNQV AALKTPGTED LTTQAWSGDN 121 GLTLIEMGPY GVIGAITPTT NPTETVICNG IGMIAAGNTV FFSPHPTAKN TSMKIITLLN 181 QAIVKAGGPN NLLTSVANPS IKAANEMMKH PGINMLVATG GPGVVKAVLS SGKKAIGAGA 241 GNPPVIVDET ADIEKAARDI VAGCSFDNNL PCIAEKEVIA IGSIADRLIT YMQKYGAYLI 301 SGSNIDRLLN VIMTVQEEKI AEGCTDKPKR SYGINKDYVG KDAKYLLSKI GIDVPDSVRV 361 VLCETPADHP FVIEELMMPV LPVVQVKDID EAIEVAVRVE HGNRHTAAMH SKNVDHLTRF 421 ARAVETTIFV KNAPSYAGIG VGGEGFTSFT LAGPTGEGIT SPRSFTRQRR CVLVDAFSIV (SEQ ID NO: 238) | E40D, V42L, A45T, A45V (alternative; not shown), Y49R, Y49K (alternative; not shown), T54G, L55C, L55H (alternative; not shown), L55L (alternative; not shown), S56G, L63F, I64S, I64A (alternative; not shown), R68A, M88R, A101R, L103T, K104V, D110N, L124I, I125N, E126A, E126G (alternative; not shown), E126Y (alternative; not shown), E126I (alternative; not shown), G128W, P129A, Y130M, Y130V (alternative; not shown), V132P, I133A, I136S, I136T (alternative; not shown), T139L, M153C, A155V, A156V, V160A, K169G, K174Y, I175C, Q181M, V184K, K185G, N190L, A197M, I201L, I201R (alternative; not shown), N205A, N205L (alternative; not shown), M208C, G212M, G212A (alternative; not shown), N214Q, G223R, V224I, V224I (alternative; not shown), K226A, A227V, A227R (alternative; not shown), A227Q (alternative; not shown), A227V (alternative; not shown), V228I, S230Q, S230V (alternative; not shown), S231G, S231G (alternative; not shown), A238S, G239S, G239D (alternative; not shown), A240R, A240N (alternative; not shown), A240E (alternative; not shown), V245T, D248S, T250F, T250L (alternative; not shown), T250V (alternative; not shown), T250A (alternative; not shown), K255R, A256T, A257S, A257T (alternative; not shown), A257C (alternative; not shown), A257V (alternative; not shown), A262I, A262C (alternative; not shown), A262W (alternative; not shown), A262V (alternative; not shown), G263S, F266L, L270I, L270T (alternative; not shown), L270S (alternative; not shown), L270M (alternative; not shown), L270N (alternative; not | 1 MSIDQALIEK ITLEILTKMQ TGAKAAPAGY GDGIFETVDD ALAATRKARQ ELKGCGLEKR 61 EVFSKAMADV AYENATILAQ MAVDESGRGR VSDKIIKNQV RATVTPGTEN LTTQAWSGDN 121 GLTINAMWAM GPAGASTPLT NPTETVICNG IGCIVGGNTA FFSPHPTAGN TSMYGITLLN 181 MAIKGAGGPL NLLTSVMNPS LKAAAEMCKH PMIQMLVATG GPRLVAVILQ GGKKAIGSSR 241 GNPPTIVSEF ADIERTSRDI VISCSLDNNI PCIAETSLIA PGSILKRVIT VFQKLGAYLI 301 SGSNIDRLLN VIMAVQEEKI AEGCTDKPKR SYGKNKDTVA KDAKYLLSKI GIDVPDWVRN 361 VACETPEDHP FVIEELHMPV LPVVQVKYID EAIEVAVRVE HPHRFTAMH SKHVDHLTRF 421 ARAVETTIFV KNAPSYAGIG VGGEGFTSFT LAGPTGEGIT SPRSFTRQRR CVLVDAFSIV (SEQ ID NO: 245) |

TABLE 58-continued

Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| | | shown), K276T, E277S, V278L, I281P, A285L, D286K, L288V, Y291V, Y291D (alternative; not shown), M292F, Y295L, R308L, R308P (alternative; not shown), T314A, I334K, G340A, S357W, V360N, L362A, A367E, M377L, M377H (alternative; not shown), D388Y, G402P, N403H, N403K (alternative; not shown), N403W (alternative; not shown), N403V (alternative; not shown), H405F, A408M, N413H | |
| coenzyme A acylating aldehyde dehydrogenase [Clostridium beijerinckii] sequence ID: gb\|AAD31841.1\| AF132754_1 | 1 MNKDTLIPTT KDLKLKTNVE NINLKNYKDN SSCFGVFENV ENAINSAVHA QKILSLHYTK 61 EQREKIITEI RKAALENKEV LATMILEETH MGRYEDKILK HELVAKYTPG TEDLTTTAWS 121 GDNGLTVVEM SPYGVIGAIT PSTNPTETVI CNSIGMIAAG NAVFNGHPG AKKCVAFAIE 181 MINKAIISCG GPENLVTTIK NPTMESLDAI IKHPLIKLLC GTGGPMVKT LLNSGKKAIG 241 AGAGNPPVIV DDTADIEKAG KSIIEGCSFD NNLPCIAEKE VFVFENVADD LISNMLKNNA 301 VIINEDQVSK LIDLVLQKNN ETQEYFINKK WVGKDAKLFS DEIDVESPSN IKCIVCEVNA 361 NHPFVMTELM MPILPIVRVK DIDEAVKYTK IAEQNRKHSA YIYSKNIDNL NRFEREIDTT 421 IFVKNAKSFA GVGYEAEGFT TFTIAGSTGE GITSARNFTR QRRCVLAG (SEQ ID NO: 239) | D12L, L15P, F34K, N42D, I44L, A47T, A47V (alternative; not shown), Q51R, Q51K (alternative; not shown), L56G, H57A, Y58C, Y58L (alternative; not shown), Y58H (alternative; not shown), Y58L (alternative; not shown), T59G, I66F, I67S, I67A (alternative; not shown), R71A, M91R, V104R, K106T, Y107V, D113N, V127I, V128N, E129A, E129G (alternative; not shown), E129A (alternative; not shown), E129Y (alternative; not shown), E129I (alternative; not shown), S131W, P132A, Y133M, Y133V (alternative; not shown), V135P, I136A, I139S, I139T (alternative; not shown), S142L, M156C, A158V, A159G, V164A, G167P, K172G, F177Y, A178G, K184M, I187K, S188G, E193L, K200M, M204L, M204R (alternative; not shown), D208A, D208L (alternative; not shown), I211C, L215M, S215A (alternative; not shown), K217Q, G226R, M227L, M227I (alternative; not shown), K229A, T230V, T230R (alternative; not shown), T230Q (alternative; not shown), T230V (alternative; not shown), L231I, N233Q, N233V (alternative; not shown), S234G, A241S, G242S, G242D (alternative; not shown), A243R, A243N (alternative; not shown), A243E (alternative; not shown), V248T, D252S, T253F, T253L (alternative; not shown), T253V (alternative; not shown), T253L (alternative; not shown), T253A (alternative; not shown), K258R, A259T, G260S, G260T (alternative; not shown), G260C (alternative; not shown), G260V (alternative; not shown), E265I, E265C (alternative; not shown), E265W (alternative; not shown), E265V (alternative; not shown), G266S, F269L, L273I, L273T (alternative; not shown), L273S (alternative; not shown), L273M (alternative; not shown), L273N (alternative; not shown), K279T, E280S, V281L, F284P, A288L, D289K, L291V, N294V, N294D (alternative; not shown), M295F, | 1 MNKDTLIPTT KLLKPKTNVE NINLKNYKDN SSCKGVFENV EDALNSTVHA RKILSGACGK 61 EQREKFSTEI AKAALENKEV LATMILEETH RGRYEDKILK HELRATVTPG TENLTTTAWS 121 GDNGLTINAM WAMGPAGAST PLTNPTETVI CNSIGCIVGG NAVAFNPHPG AGKCVAYGIE 181 MINMAIKGCG GPLNLVTTIM NPTLESLAAI CKHPMIQLLC GTGGPRLVAV ILQGGKKAIG 241 SSRGNPPTIV DSFADIERTG KSIIISCSLD NNIPCIAETS LFVPENVLKD VISVFLKLNA 301 VIINEDQVSL LIDLVLAKNN ETQEYFKNKK WVAKDAKLFS DEIDVESPWN IKCVACEVNE 361 NHPFVMTELL MPILPIVRVK DIYEAVKYTK IAERPHKPSA MIYSKHIDNL WRPERGADST 421 IFVKNGLSLA GVGYEAPGFT SFTIAVPTGE GMTSAANFTR QRRTVNAN (SEQ ID NO: 246) |

TABLE 58-continued

Exemplary ALD enzyme variants.

| Wild-Type Designation | Wild-Type Sequence | Corresponding Positions and Amino Acid Changes | Exemplary Enzyme Sequence Indicating Corresponding Positions |
|---|---|---|---|
| | | N298L, K310L, K310P (alternative; not shown), Q317T, Q317T (alternative; not shown), I327K, G333A, S349W, C353R, V355A, A360E, M370L, M370H (alternative; not shown), D383Y, N395P, R396H, R396K (alternative; not shown), R396W (alternative; not shown), R396V (alternative; not shown), H398F, Y401M, N406H | |
| Aldehyde Dehydrogenase [Caldalkalibacillus thermarum TA2.A1] Sequence ID: ref\|ZP_08533507.1\| Length: 527 | 1 MNMTEKDIEK IVQSVLHNVE SALGKSASAS PSVSAVSVAS GEGIKPVQFK QVPVFQQETV 61 KSPNRNRNLG GAEEKWGVFN HMEDAIEASY RAQMEFVKHF QLKDREKIIT AIREAVLREK 121 EVLARKVYEE TKIGRYEDKV AKHELAALKT PGTEDLKTEA FSGDNGLTIV ERAPYGLIGA 181 VTPVTNPTET IINNAIGMLA AGNAVFNVH PSSKRSCAYA VQLINKAITE AGGPHHLVTM 241 VKEPTLDTLQ TLIDSPKVKL LVGTGPGLV QTLLKSGKKA IGAGAGNPPV IVDDTADLEH 301 AARSIIRGAA FDNNLLCIAE KEVFVLESVA DDLIFHMLNH GAYMLGQHEV EQVMAFALEE 361 QGNEQNRGCG FNPQRHYQVS KDWIGQDARL FLEHIGVQPP TEVKLLICDV EFDHPFVQLE 421 QMMPVLPIVR VKTLDEAIEK AVMAEHGNRH TAIMHSKNVD HLTKFARAIQ TTLFVKNASS 481 LAGVGYGGEG HTTMTIAGPT GEGVTSAKTF TRERRCVLAE GGFRIIG (SEQ ID NO: 240) | I133R, A146R, L148T, K149V, D155N, V170N, E171A, E171G (alternative; not shown), E171Y (alternative; not shown), A173W, P174A, Y175M, Y175V (alternative; not shown), L177P, I178A, V181S, V181T (alternative; not shown), V184L, M198C, A200V, A201G, V206A, V209P, K214G, F219Y, A220G, K226M, T229K, E230G, H235L, K242M, L246R, Q250A, Q250L (alternative; not shown), I253C, K257M, K257A (alternative; not shown), K259Q, G268R, L269I, Q271A, T272V, T272R (alternative; not shown), T272Q (alternative; not shown), T272V (alternative; not shown), L273I, K275Q, K275V (alternative; not shown), S276G, A283S, G284S, G284D (alternative; not shown), A285R, A285N (alternative; not shown), A285E (alternative; not shown), V290T, D294S, T295F, T295L (alternative; not shown), T295V (alternative; not shown), H300R, A301T, A302S, A302T (alternative; not shown), A302C (alternative; not shown), A302V (alternative; not shown), E307I, E307O (alternative; not shown), E307T, E307C (alternative; not shown), E307V (alternative; not shown), G308S, F311L, L315I, L315T (alternative; not shown), L315S (alternative; not shown), L315N (alternative; not shown), L315M (alternative; not shown), K321T, E322S, V323L, L326P, A330L, D331K, L333V, H336V, H336D (alternative; not shown), M337F, H340L, Q352L, Q352P (alternative; not shown), V379K, G385A, E359A, E359T (alternative; not shown), V379K, G385A, T401W, L405N, I407A, F412E | 1 MNMTEKDIEK IVQSVLHNVE SALGKSASAS PSVSAVSVAS GEGIKPVQFK QVPVFQQETV 61 KSPNRNRNLG GAEEKWGVFN HMEDAIEASY RAQMEFVKHF QLKDREKIIT AIREAVLREK 121 EVLARKVYEE TKRGRYEDKV AKHELRATVT PGTENLKTEA FSGDNGLTIN ARWAMGPAGA 181 STPLTNPTET IINNAIGCLV GGNAVAFNPH PSSGRSCAYG VQLINMAIKG AGGPLHLVTM 241 VMEPTRDTLA TLCDSPMVQL LVGTGPRIV AVTLQGGKKA IGSSRGNPPT IVDSFADLER 301 TsRSIISGAA LDNNILCIAE TSLFVPESVL KDVIFVFLNL GAYMLGQHEV ELVMAFALAE 361 QGNEQNRGCG FNPQRHYQKS KDWIAQDARL FLEHIGVQPP WEVKINICDV EEDHPFVQLE 421 QMMPVLPIVR VKTLDEAIEK AVMAEHGNRH TAIMHSKNVD HLTKFARAIQ TTLFVKNASS 481 LAGVGYGGEG HTTMTIAGPT GEGVTSAKTF TRERRCVLAE GGFRIIG (SEQ ID NO: 247) |

Exemplary ALD variants include, but are not limited to, single substitutions, or a combination of one or more of the substitutions, at 12L, 15P, 34K, 42D, 44L, 47T, 51R, 51R, 51K, 56G, 57A, 58C, 58L, 58H, 58L, 59G, 66F, 67S, 67A, 71A, 91R, 104R, 106T, 107V, 127I, 128N, 129A, 129G, 129Y, 129I, 131W, 132A, 133M, 133V, 133M, 135P, 136A, 139S, 139T, 142L, 156C, 158V, 159G, 164A, 167P, 172G, 178G, 184M, 187K, 188G, 200M, 204L, 204R, 208A, 208L, 211C, 215M, 215A, 217Q, 226R, 227L, 227I, 229A, 230V, 230R, 230R, 230Q, 230V, 231I, 233Q, 233V, 234G, 241S, 242S, 242D, 243R, 243N, 243E, 248T, 252S, 253F, 253L, 253V, 253L, 253A, 258R, 259T, 260S, 260T, 260C, 265I, 265C, 265W, 265V, 266S, 269L, 273I, 273T, 273S, 273M, 273T, 273N, 279T, 280S, 281L, 284P, 288L, 289K, 291V, 294V, 295F, 298L, 310L, 310P, 317A, 317T, 327K, 333A, 349W, 360E, 370L, 370H, 395P, 396H, 396K, 396W, 396V, 398F, 401M, 406H, 411W, 416G, 416S, 417A, 419S, 426G, 427L, 427F, 427V, 427L, 429L, 429M, 437F, 439H, 441S, 446V, 446I, 447P, 456A, 464T, 464S, 466N, 468N for representative sequence(s) shown in Table 58; 12L, 15P, 34K 42D, 44L, 47T, 47V, 51R, 51R, 51K, 56G, 57A, 58C, 58L, 58H, 59G, 66F, 67S, 67A, 71A, 91R, 104R, 106T, 107V 113N, 127I, 128N, 129A, 129G, 129Y, 129I, 131W, 132A, 133M, 133V, 133M, 135P, 136A, 139S, 139T, 142L, 156C, 158V, 159G, 164A, 167P, 172G, 177Y, 178G, 184M, 187K, 188G, 193L, 200M, 204L, 204R, 208A, 208L, 211C, 215M, 215A, 217Q, 226R, 227L, 227I, 229A, 230V, 230R, 230R, 230Q, 230V, 231I, 233Q, 233V, 234G, 234G, 241S, 242S, 242D, 243R, 243N, 243E, 248T, 252S, 253F, 253L, 253V, 253A, 258R, 259T, 260S, 260T, 260C, 260V, 265I, 265C, 265W, 265V, 266S, 269L, 273I, 273T 273S 273M 273T 273N 279T 280S 281L 284P 288L 289K 291V 294V 294D 295F 298L 310L 310P 317A 317T 327K 333A 349W 353N 355A 360E 370L 370H 383Y 395P 396H 396K 396W 396V 398F 401M 406H for representative sequence(s) shown in Table 58; D13L, I16P, L32K, N40D, I42L, A45T, A45V Q49R, Q49R, Q49K, L54G, Y55A, Y56C, Y56L, Y56H, Y56L, T57G, I64F, I65S, I65A, R69A, M89R, V102R, K104T, Y105V, D111N, V125I, V126N, E127A, E127G, E127A, E127Y, E127I, S129W, P130A, Y131M, Y131V, Y131M, V133P, I134A, I137S, I137T, S140L, M154C, A156V, A156V, A157G, V162A, G165P, K170G, F175Y, A176G, K182M, I185K, S186G, E191L, K198M, M202L, M202R, N206A, N206L, M209C, Y213M, Y213A, K215Q, G224R, L225I, K227A, T228V, T228R, T228R, T228Q, T228V, L229I, N231Q, N231V, S232G, S232G A239S, A239S, G240S, G240D, A241R, A241N, A241E, V246T, D250S, T251F, T251L, T251V, T251L, T251A, K256R, A257T, G258S, G258T, G260C, G260V, E263I, E263C, E263W, E263V, G264S, G264S, F267L, L271I, L271T, L271S, L271M, L271T, L271N, K277T, E278S, V279L, F282P, A286L, D287K, L289V, N292V, N292D, M293F, N296L, K308L, K308P, E316A, E316T, I326K, G332A, D348W, C352N, I354A, A359E, M369L, M369H, D382Y, R394P, K395H, K395K, K395W, K395V, H397F, Y400M, N405H for representative sequence(s) shown in Table 58; I133R, A146R, L148T, K149V, D155N, V170N, E171A, E171G, E171A, E171Y, E171I, A173W, P174A, Y175M, Y175V, Y175M, L177P, I178A, V181S, V181T, V184L, M198C, A200V, A201G, V206A, V209P, K214G F219Y, A220G, K226M, T229K, E230G H235L, K242M, L246R, Q250A, Q250L, I253C, K257M, K257A, K259Q, G268R, L269I, Q271A, P272V, T272R, T272R, T272Q, T272V, L273I, K275Q, K275V, S276 S276 A283S, A283S, G284S, G284D, A285R, A285N, A285E, V290T, D294S, T295F, T295L, T295V, T295A, H300R, A301T, A302S, A302T, A302C, A302V, E307I, E307C, E307W, E307V, G308S, G308S, F311L, L315I, L315T, L315S, L315M, L315T, L315N, K321T, E322S, V323L, L326P, A330L, D331K, L333V, H336V, H336D, M337F, H340L, Q352L, Q352P, E359A, E359T, V379K, G385A, T401W, L405N, I407A, F412E for representative sequence(s) shown in Table 58; E40D, V42L, A45T, A45V, Y49R, Y49R, Y49K, T54G, L55C, L55H, L55L, S56G, L63F, I64S, I64A, R68A, M88R, A101R, L103T, K104V, D110N, L124I, I125N, E126A, E126G, E126Y, E126I, G128W, P129A, Y130M, Y130V, Y130M, V132P, I133A, I136S, I136T, T139L, M153C, A155V, A156G, V160A, K169G, K174Y, I175G, Q181M, V184K, L185G, N190L, A197M, I201L, I201R, N205A, N205L, M208C, G212M, G212A, N214Q, G223R, V224L, V224I, K226A, A227V, A227R, A227R, A227Q, A227V, V228I, S230Q, S230V, S231G, S231G, A238S, A238S, G239S, G239D, A240R, A240N, A240E, V245T, D248S, T250F, T250L, T250V, T250A, K255R, A256T, A257S, A257T, A257C, A257V, A262I, A262C, A262W, A262V, G263S, F266L, L270I, L270T, L270S, L270M, L270T, L270N, K276T, E277S, V278L, I281P, A285L, D286K, L288V, Y291V, Y291D, M292F, Y295L, R308L, R308P, T314A, I334K, G340A, S357W, V360N, L362A, A367E, M377L, M377H, D388Y, G402P, N403H, N403K, N403W, N403V, H405F, A408M for representative sequence(s) shown in Table 58.

Representative combinations include combinations of the single substitutions exemplified in Table 58 as in the corresponding respective sequences, including but not limited to: 12A; 12V; 139S; 139T; 204R; 361S; 396H; 417A; 129Y, 129I, 131W, 132A, 133M, 215M, 217Q, 226R, 230V, 259T; 132A, 133M, 133V, 136A, 139S, 142L, 156C, 158V, 159G, 164A, 167P, 187K, 188G, 200M; 241S, 242D, 243N, 248T, 252S, 253F, 258R, 259T; 396H, 396W; 142L, 156C; 129I, 131W; 394R, 411Y, 291V, 295F, 310L; 294V, 298L, 310L; 129A, 131W, 132A, 133M; 56G, 426G; 208L, 456A; 30N, 260V; 129I, 447P; 233Q, 291V, 466N; 355A, 479R; 273T, 439H, 468N; 117T, 446V; 12L, 310L, 446I, 464S; 139S, 204R, 241S, 396H, 417A; 253V, 437P; 58L, 269L, 298L; 139S, 204R; 67S, 231I, 273S, 447P; 129A, 427L; 139S, 204R, 417A; 91R, 184M, 427L, 464T; 253F, 427V; 333A, 429L; 139T, 204R, 241S, 396H, 417A; 67A, 217Q; 129I, 280S, 429M; 12A, 139S, 204R, 396H; 295F, 298L, 310L, 310P, 327K, 353N; 211C, 242D, 427V; 164A, 427L, 456A, 466N; 12V, 139S, 204R, 396H; 139S, 204R, 396H; 12V, 139S, 204R, 361S, 396H; 66F, 241S, 273T, 310P, 406H, 446V, 464T; 294D, 383Y 135P, 211C, 396H, 401M; 281L, 396H, 401M; 204R, 281L, 396H, 401M; 204R, 211C, 396H, 401M; 204R, 396H, 401M; 129I, 135P, 204R, 396H; 129I, 135P, 211C; 129I, 135P, 211C, 396H; 129I, 135P, 396H; 129I, 135P, 281L, 396H; 211C, 281L, 396H, 401M; 211C, 281L, 401M; 211C, 401M; 204R, 211C, 370L, 396H; 204R, 211C, 281L, 396H, 401M; 204R, 211C, 281L, 401M; 204R, 211C, 401M; 204R, 281L, 401M; 135P, 204R, 211C, 401M; 129I, 135P, 211C, 396H, 401M; 129I, 135P, 204R, 211C; 129I, 135P, 204R, 211C, 396H; 204R, 401M; 129I, 135P, 204R, 396I, 437P; 12A, 139S, 204R, 361S, 396H; 15P, 129G, 167P, 227I, 258R, 260T, 298L, 406H, 446I; 124R, 139S, 204R, 396H, 413S; 67S, 129A, 215A, 419S; 353N, 452M; 58L, 217Q, 242D, 273N; 34K, 437P; 139S, 204R, 396H, 417A; 294V, 327K; 59G, 259T, 280S, 333A; 167P, 401M; 139T, 204R, 417A; 164A, 398F, 411W; 47V, 177Y; 172G, 360E; 158V, 317T; 57A, 273N, 360E; 113N, 193L; 215A, 416S, 446I; 132A, 178G, 310L, 370H; 172G, 327K, 464T; 294V, 295F, 327K; 44L, 446I; 204R, 396H, 417A; 12L, 187K, 317T, 441S; 158V, 441S; 215M, 327K, 406H, 464T, and the like. It is readily apparent that these an other combinations can be readily made, used and screened using methods well known in the art and as disclosed herein. Based on methods well known in the art for aligning homologous sequences, as described herein, the corresponding positions for the indicated variant amino acid positions of Table 58 can be readily determined for a homologous ALD sequence.

As disclosed herein, it is well known to those skilled in the art that different organisms can exhibit codon bias that can affect expression of a gene. Therefore, any of the variants described herein can optionally be codon optimized for the desired amino acid at a particular position, as discussed above. Table 59 shows the well known genetic code, and one skilled in the art can readily incorporate alternative codons, where desired, into a variant to optimize expression and production, including increased expression and production, of a a desired product in a variant host strain.

TABLE 59

Genetic code for translation from nucleotide sequence to amino acid sequence.

| | | Second base | | | | | |
|---|---|---|---|---|---|---|---|
| | | U | C | A | G | | |
| First base | U | Phe | Ser | Tyr | Cys | U | Third base |
| | | Phe | Ser | Tyr | Cys | C | |
| | | Leu | Ser | End | End | A | |
| | | Leu | Ser | End | Trp | G | |
| | C | Leu | Pro | His | Arg | U | |
| | | Leu | Pro | His | Arg | C | |
| | | Leu | Pro | Gln | Arg | A | |
| | | Leu | Pro | Gln | Arg | G | |
| | A | Ile | Thr | Asn | Ser | U | |
| | | Ile | Thr | Asn | Ser | C | |

TABLE 59-continued

Genetic code for translation from nucleotide sequence to amino acid sequence.

| | | Second base | | | | |
|---|---|---|---|---|---|---|
| | | U | C | A | G | |
| | | Ile | Thr | Lys | Arg | A |
| | | Met | Thr | Lys | Arg | G |
| | G | Val | Ala | Asp | Gly | U |
| | | Val | Ala | Asp | Gly | C |
| | | Val | Ala | Glu | Gly | A |
| | | Val | Ala | Glu | Gly | G |

In addition, as additionally described herein, one skilled in the art can readily incorporate amino acid substitutions, in particular conservative amino acid substitutions, to generate additional enzyme variants, which can be screened for desired activities and/or properties using the methods disclosed herein and/or well known in the art. Further, alignments of related sequences, such as those exemplified in Tables 53-58, can be used to guide the identification of additional amino acid positions to either vary or maintain as an invariant position using routine methods well known to those skilled in the art.

Throughout this application various publications have been referenced. The disclosures of these publications in their entireties, including GenBank and GI number publications, are hereby incorporated by reference in this application in order to more fully describe the state of the art to which this invention pertains. Although the invention has been described with reference to the examples provided above, it should be understood that various modifications can be made without departing from the spirit of the invention.

SEQUENCE LISTING (519 sequences)

SEQ ID NO: 1 - DNA, 59 bp, Artificial Sequence
  Description of Artificial Sequence: Synthetic primer
gacgaattcgctagcaagaggagaagtcgacatgtccaattcactggccgtcgttttac

SEQ ID NO: 2 - DNA, 47 bp, Artificial Sequence
  Description of Artificial Sequence: Synthetic primer
gaccctaggaagctttctagagtcgacctatgcggcatcagagcaga

SEQ ID NO: 3 - DNA, 18 bp, Artificial Sequence
  Description of Artificial Sequence: Synthetic primer
atgtaccgcaagttccgc

SEQ ID NO: 4 - DNA, 18 bp, Artificial Sequence
  Description of Artificial Sequence: Synthetic primer
caatttgccgatgcccag

SEQ ID NO: 5 - DNA, 20 bp, Artificial Sequence
  Description of Artificial Sequence: Synthetic primer
gctgaccactgaagactttg

SEQ ID NO: 6 - DNA, 19 bp, Artificial Sequence
  Description of Artificial Sequence: Synthetic primer
gatcagggcttcggtgtag

SEQ ID NO: 7 - DNA, 27 bp, Artificial Sequence
  Description of Artificial Sequence: Synthetic primer
ttggtgcgggccaagcaggatctgctc

SEQ ID NO: 8 - DNA, 30 bp, Artificial Sequence
  Description of Artificial Sequence: Synthetic primer
tcagccgaacgcctcgtcgaggatctcctg

SEQ ID NO: 9 - DNA, 32 bp, Artificial Sequence
  Description of Artificial Sequence: Synthetic primer
tggccaacataagttcaccattcgggcaaaac

SEQ ID NO: 10 - DNA, 29 bp, Artificial Sequence
  Description of Artificial Sequence: Synthetic primer
tctcttcaaccagccattcgttttgcccg

SEQ ID NO: 11 - DNA, 27 bp, Clostridium acetobutylicum
attaaagttaagtggaggaatgttaac

SEQ ID NO: 12 - DNA, 22 bp, Artificial Sequence
  Description of Artificial Sequence: Synthetic primer
acacgcggatccaacgtcccgg

SEQ ID NO: 13 - DNA, 23 bp, Artificial Sequence
  Description of Artificial Sequence: Synthetic primer
agcggctccgctagccgcttatg

SEQ ID NO: 14 - DNA, 24 bp, Artificial Sequence
  Description of Artificial Sequence: Synthetic primer
aagccgttgctgcagctcttgagc

SEQ ID NO: 15 - DNA, 23 bp, Artificial Sequence
  Description of Artificial Sequence: Synthetic primer
atctccggcggtcggatccgtcg

SEQ ID NO: 16 - DNA, 20 bp, Artificial Sequence
  Description of Artificial Sequence: Synthetic primer
aaagcggctagccacgccgc

SEQ ID NO: 17 - DNA, 20 bp, Artificial Sequence
  Description of Artificial Sequence: Synthetic primer
attacacgaggtacccaacg

SEQ ID NO: 18 - DNA, 22 bp, Artificial Sequence
  Description of Artificial Sequence: Synthetic primer
atgctggcgtacaaaggtgtcc

SEQ ID NO: 19 - DNA, 22 bp, Artificial Sequence
  Description of Artificial Sequence: Synthetic primer
ggacacctttgtacgccagcat

SEQ ID NO: 20 - DNA, 25 bp, Artificial Sequence
  Description of Artificial Sequence: Synthetic primer
atcgcctacactaaaccagaagtgg

SEQ ID NO: 21 - DNA, 25 bp, Artificial Sequence
  Description of Artificial Sequence: Synthetic primer
ccacttctggtttagtgtaggcgat

SEQ ID NO: 22 - DNA, 20 bp, Artificial Sequence
  Description of Artificial Sequence: Synthetic primer
aggcagttccataggatggc

SEQ ID NO: 23 - DNA, 55 bp, Artificial Sequence
  Description of Artificial Sequence: Synthetic primer
tgacatgtaacacctaccttctgtgcctgtgccagtggttgctgtgatatagaag

SEQ ID NO: 24 - DNA, 48 bp, Artificial Sequence
  Description of Artificial Sequence: Synthetic primer
ataataatacatatgaaccatgcgagttacgggcctataagccaggcg

SEQ ID NO: 25 - DNA, 42 bp, Artificial Sequence
  Description of Artificial Sequence: Synthetic primer
agtttttcgatatctgcatcagacaccggcacattgaaacgg

SEQ ID NO: 26 - DNA, 60 bp, Artificial Sequence
  Description of Artificial Sequence: Synthetic primer
ctggcacaggcacagaaggtaggtgttacatgtcagaacgtttacacaatgacgtggatc

SEQ ID NO: 27 - DNA, 49 bp, Artificial Sequence
  Description of Artificial Sequence: Synthetic primer
agacaaatcggttgccgtttgttaagccaggcgagatatgatctatatc

SEQ ID NO: 28 - DNA, 54 bp, Artificial Sequence
  Description of Artificial Sequence: Synthetic primer
gagttttgatttcagtactcatcatgtaacacctaccttcttgctgtgatatag

SEQ ID NO: 29 - DNA, 54 bp, Artificial Sequence
  Description of Artificial Sequence: Synthetic primer
ctatatcacagcaagaaggtaggtgttacatgatgagtactgaaatcaaaactc

SEQ ID NO: 30 - DNA, 49 bp, Artificial Sequence
  Description of Artificial Sequence: Synthetic primer
gatatagatcatatctcgcctggcttaacaaacggcaaccgatttgtct

SEQ ID NO: 31 - DNA, 70 bp, Artificial Sequence
  Description of Artificial Sequence: Synthetic oligonucleotide
tattgtgcatacagatgaatttttatgcaaacagtcagccctgaagaagggtgtaggctggagctgcttc

SEQ ID NO: 32 - DNA, 70 bp, Artificial Sequence
  Description of Artificial Sequence: Synthetic oligonucleotide
caaaaaaccggagtctgtgctccggttttttattatccgctaatcaattacatatgaatatcctccttag

SEQ ID NO: 33 - DNA, 51 bp, Artificial Sequence
  Description of Artificial Sequence: Synthetic primer
ataataatagaattcgtttgctacctaaattgccaactaaatcgaaacagg

SEQ ID NO: 34 - DNA, 47 bp, Artificial Sequence
  Description of Artificial Sequence: Synthetic primer
tattattatggtaccaatatcatgcagcaaacggtgcaacattgccg

SEQ ID NO: 35 - DNA, 47 bp, Artificial Sequence
  Description of Artificial Sequence: Synthetic primer
tgatctggaagaattcatcggctttaccaccgtcaaaaaaaacggcg

SEQ ID NO: 36 - DNA, 48 bp, Artificial Sequence
  Description of Artificial Sequence: Synthetic primer
ataaaaccctgcagcggaaacgaagttttatccatttttggttacctg

SEQ ID NO: 37 - DNA, 35 bp, Artificial Sequence
  Description of Artificial Sequence: Synthetic primer
ggaagagaggctggtacccagaagccacagcagga

SEQ ID NO: 38 - DNA, 38 bp, Artificial Sequence
  Description of Artificial Sequence: Synthetic primer
gtaatcactgcgtaagcgccatgccccggcgttaattc

SEQ ID NO: 39 - DNA, 25 bp, Artificial Sequence
  Description of Artificial Sequence: Synthetic primer
attgccgcgttcctcctgctgtcga

SEQ ID NO: 40 - DNA, 24 bp, Artificial Sequence
  Description of Artificial Sequence: Synthetic primer
cgacagcaggaggaacgcggcaat

SEQ ID NO: 41 - DNA, 75 bp, Artificial Sequence
  Description of Artificial Sequence: Synthetic primer
gtttgcacgctatagctgaggttgttgtcttccagcaacgtaccgtatacaataggcgtatcacgaggccctttc

SEQ ID NO: 42 - DNA, 70 bp, Artificial Sequence
  Description of Artificial Sequence: Synthetic primer
gctacagcatgtcacacgatctcaacggtcggatgaccaatctggctggtatgggaattagccatggtcc

SEQ ID NO: 43 - DNA, 73 bp, Artificial Sequence
  Description of Artificial Sequence: Synthetic oligonucleotide
tgtgagtgaaagtcacctgccttaatatctcaaaactcatcttcgggtgacgaaatatggcgtgactcgatac

SEQ ID NO: 44 - DNA, 70 bp, Artificial Sequence
  Description of Artificial Sequence: Synthetic oligonucleotide
tctgtatcaggctgaaaatcttctctcatccgccaaaacagcttcggcgttaagatgcgcgctcaaggac

SEQ ID NO: 45 - protein, 20 aa, Euglena gracilis
MTYKAPVKDVKFLLDKVFKV

SEQ ID NO: 46 - DNA, 2036 bp, Escherichia coli
atgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataa

SEQ ID NO: 47 - protein, 388 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 48 - protein, 289 aa, Escherichia coli
MSILIDKNTKVICQGFTGSQGTFHSEQAIAYGTKMVGGVTPGKGGTTHLGLPVFNTVREAVAATGATASVIYVPAPFCKDSILEAIDAGIKLIITITEGIPTLDMLTVKVKLDEAGVRMIGPNCPGVITPGECKIGIQPGHIHKPGKVGIVSRSGTLTYEAVKQTTDYGFGQSTCVGIGGDPIPGSNFIDILEMFEKDPQTEAIVMIGEIGGSAEEEAAAYIKEHVTKPVVGYIAGVTAPKGKRMGHAGAIIAGGKGTADEKFAALEAAGVKTVRSLADIGEALKTVLK

SEQ ID NO: 49 - DNA, 3696 bp, Mycobacterium bovis
atggccaacataagttcaccattcgggcaaaacgaatggctggttgaagagatgtaccgcaagttccgcgacgacccctcctcggtcgatcccagctggcacgagttcctggttgactacagccccgaacccacctcccaaccagctgccgaaccaacccgggttacctcgccactcgttgccgagcgggccgctgcggccgccccgcaggcaccccccaagccggccgacaccgcggccgcgggcaacggcgtggtcgccgcactggccgccaaaactgccgttcccccgccagccgaaggtgacgaggtagcggtgctgcgcggcgccgccgcggccgtcgtcaagaacatgtccgcgtcgttggaggtgccgacggcgaccagcgtccgggcggtcccggccaagctactgatcgacaaccggatcgtcatcaacaaccagttgaagcggacccgcggcggcaagatctcgttcacgcatttgctgggctacgccctggtgcaggcggtgaagaaattcccgaacatgaaccggcactacaccgaagtcgacggcaagcccaccgcggtcacgccggcgcacaccaatctcggcctggcgatcgacctgcaaggcaaggacgggaagcgttccctggtggtggccggcatcaagcggtgcgagaccatgcgattcgcgcagttcgtcacggcctacgaagacatcgtacgccgggcccgcgacggcaagctgaccactgaagactttgccggcgtgacgatttcgctgaccaatcccggaaccatcggcaccgtgcattcggtgccgcggctgatgcccggccagggcgccatcatcggcgtgggcgccatggaataccccgccgagtttcaaggcgccagcgaggaacgcatcgccgagctgggcatcggcaaattgatcactttgacctccacctacgaccaccgcatcatccagggcgcggaatcgggcgacttcctgcgcaccatccacgagttgctgctctcggatggcttctgggacgaggtcttccgcgaactgagcatcccatatctgccggtgcgctggagcaccgacaaccccgactcgatcgtcgacaagaacgctcgcgtcatgaacttgatcgcggcctaccgcaaccgcggccatctgatggccgataccgacccgctgcggttggacaaagctcggttccgcagtcaccccgacctcgaagtgctgacccacggcctgacgctgtgggatctcgatcgggtgttcaaggtcgacggctttgccggtgcgcagtacaagaaactgcgcgacgtgctgggcttgctgcgcgatgcctactgccgccacatcggcgtggagtacgcccatatcctcgaccccgaacaaaaggagtggctcgaacaacgggtcgagaccaagcacgtcaaacccactgtggcccaacagaaatacatcctcagcaagctcaacgccgccgaggcctttgaaacgttcctacagaccaagtacgtcggccagaagcggttctcgctggaaggcgccgaaagcgtgatcccgatgatggacgcggcgatcgaccagtgcgctgagcacggcctcgacgaggtggtcatcgggatgccgcaccggggccggctcaacgtgctggccaacatcgtcggcaagccgtactcgcagatcttcaccgagttcgagggcaacctgaatccgtcgcaggcgcacggctccggtgacgtcaagtaccacctgggcgccaccgggctgtacctgcagatgttcggcgacaacgacattcaggtgtcgctgaccgccaacccgtcgcatctggaggccgtcgacccggtgctggagggattggtgcgggccaagcaggatctgctcgaccacggaagcatcgacagcgacggccaacgggcgttctcggtggtgccgctgatgttgcatggcgatgccgcgttcgccggtcagggtgtggtcgccgagacgctgaacctggcgaatctgccgggctaccgcgtcggcggcaccatccacatcatcgtcaacaaccagatcggcttcaccaccgcgcccgagtattccaggtccagcgagtactgcaccgacgtcgcaaagatgatcggggcaccgatctttcacgtcaacggcgacgacccggaggcgtgtgtctgggtggcgcggttggcggtggacttccgacaacggttcaagaaggacgtcgtcatcgacatgctgtgctaccgccgccgcgggcacaacgagggtgacgacccgtcgatgaccaacccctacatgtacgacgtcgtcgacaccaagcgcggggcccgcaaaagctacaccgaagccctgatcggacgtggcgacatctcgatgaaggaggccgaggacgcgctgcgcgactaccagggccagctggaacgggtgttcaacgaagtgcgcgagctggagaagcacggtgtgcagccgagcgagtcggtcgagtccgaccagatgattcccgcggggctggccactgcggtggacaagtcgctgctggcccggatcggcgatgcgttcctcgccttgccgaacggcttcaccgcgcacccgcgagtccaaccggtgctggagaagcgccgggagatggcctatgaaggcaagatcgactgggcctttggcgagctgctggcgctgggctcgctggtggccgaaggcaagctggtgcgcttgtcggggcaggacagccgccgcggcaccttctcccagcggcattcggttctcatcgaccgccacactggcgaggagttcacaccactgcagctgctggcgaccaactccgacggcagcccgaccggcggaaagttcctggtctacgactcgccactgtcggagtacgccgccgtcggcttcgagtacggctacactgtgggcaatccggacgccgtggtgctctgggaggcgcagttcggcgacttcgtcaacggcgcacagtcgatcatcgacgagttcatcagctccggtgaggccaagtggggccaattgtccaacgtcgtgctgctgttaccgcacgggcacgaggggcagggacccgaccacacttctgcccggatcgaacgcttcttgcagttgtgggcggaaggttcgatgaccatcgcgatgccgtcgactccgtcgaactacttccacctgctacgccggcatgccctggacggcatccaacgcccgctgatcgtgttcacgcccaagtcgatgttgcgtcacaaggccgccgtcagcgaaatcaaggacttcaccgagatcaagttccgctcagtgctggaggaacccacctatgaggacggcatcggagaccgcaacaaggtcagccggatcctgctgaccagtggcaagctgtattacgagctggccgcccgcaaggccaaggacaaccgcaatgacctcgcgatcgtgcggcttgaacagctcgccccgctgcccaggcgtcgactgcgtgaaacgctggaccgctacgagaacgtcaaggagttcttctgggtccaagaggaaccggccaaccagggtgcgtggccgcgattcgggctcgaactacccgagctgctgcctgacaagttggccgggatcaagcgaatctcgcgccgggcgatgtcagccccgtcgtcaggctcgtcgaaggtgcacgccgtcgaacagcaggagatcctcgacgaggcgttcggctaa

SEQ ID NO: 50 - protein, 1231 aa, Mycobacterium bovis
MANISSPFGQNEWLVEEMYRKFRDDPSSVDPSWHEFLVDYSPEPTSQPAAEPTRVTSPLVAERAAAAAPQAPPKPADTAAAGNGVVAALAAKTAVPPPAEGDEVAVLRGAAAAVVKNMSASLEVPTATSVRAVPAKLLIDNRIVINNQLKRTRGGKISFTHLLGYALVQAVKKFPNMNRHYTEVDGKPTAVTPAHTNLGLAIDLQGKDGKRSLVVAGIKRCETMRFAQFVTAYEDIVRRARDGKLTTEDFAGVTISLTNPGTIGTVHSVPRLMPGQGAIIGVGAMEYPAEFQGASEERIAELGIGKLITLTSTYDHRIIQGAESGDFLRTIHELLLSDGFWDEVFRELSIPYLPVRWSTDNPDSIVDKNARVMNLIAAYRNRGHLMADTDPLRLDKARFRSHPDLEVLTHGLTLWDLDRVFKVDGFAGAQYKKLRDVLGLLRDAYCRHIGVEYAHILDPEQKEWLEQRVETKHVKPTVAQQKYILSKLNAAEAFETFLQTKYVGQKRFSLEGAESVIPMMDAAIDQCAEHGLDEVVIGMPHRGRLNVLANIVGKPYSQIFTEFEGNLNPSQAHGSGDVKYHLGATGLYLQMFGDNDIQVSLTANPSHLEAVDPVLEGLVRAKQDLLDHGSIDSDGQRAFSVVPLMLHGDAAFAGQGVVAETLNLANLPGYRVGGTIHIIVNNQIGFTTAPEYSRSSEYCTDVAKMIGAPIFHVNGDDPEACVWVARLAVDFRQRFKKDVVIDMLCYRRRGHNEGDDPSMTNPYMYDVVDTKRGARKSYTEALIGRGDISMKEAEDALRDYQGQLERVFNEVRELEKHGVQPSESVESDQMIPAGLATAVDKSLLARIGDAFLALPNGFTAHPRVQPVLEKRREMAYEGKIDWAFGELLALGSLVAEGKLVRLSGQDSRRGTFSQRHSVLIDRHTGEEFTPLQLLATNSDGSPTGGKFLVYDSPLSEYAAVGFEYGYTVGNPDAVVLWEAQFGDFVNGAQSIIDEFISSGEAKWGQLSNVVLLLPHGHEGQGPDHTSARIERFLQLWAEGSMTIAMPSTPSNYFHLLRRHALDGIQRPLIVFTPKSMLRHKAAVSEIKDFTEIKFRSVLEEPTYEDGIGDRNKVSRILLTSGKLYYELAARKAKDNRNDLAIVRLEQLAPLPRRRLRETLDRYENVKEFFWVQEEPANQGAWPRFGLELPELLPDKLAGIKRISRRAMSAPSSGSSKVHAVEQQEILDEAFG

SEQ ID NO: 51 - DNA, 1356 bp, Porphyromonas gingivalis
atggaaatcaaagaaatggtgagccttgcacgcaaggctcagaaggagtatcaagctacccataaccaagaagcagttgacaacatttgccgagctgcagcaaaagttatttatgaaaatgcagctattctggctcgcgaagcagtagacgaaaccggcatgggcgtttacgaacacaaagtggccaagaatcaaggcaaatccaaaggtgtttggtacaacctccacaataaaaaatcgattggtatcctcaatatagacgagcgtaccggtatgatcgagattgcaaagcctatcggagttgtaggagccgtaacgccgacgaccaacccgatcgttactccgatgagcaatatcatctttgctcttaagacctgcaatgccatcattattgccccccaccccagatccaaaaaatgctctgcacacgcagttcgtctgatcaaagaagctatcgctccgttcaacgtaccggaaggtatggttcagatcatcgaagaacccagcatcgagaagacgcaggaactcatgggcgccgtagacgtagtagttgctacgggtggtatgggcatggtgaagtctgcatattcttcaggaaagccttctttcggtgttggagccggtaacgttcaggtgatcgtggatagcaacatcgatttcgaagctgctgcagaaaaaatcatcaccggtcgtgctttcgacaacggtatcatctgctcaggcgaacagagcatcatctacaacgaggctgacaaggaagcagttttcacagcattccgcaaccacggtgcatatttctgtgacgaagccgaaggagatcgggctcgtgcagctatcttcgaaaatggagccatcgcgaaagatgtagtaggtcagagcgttgccttcattgccaagaaagcaaacatcaatatccccgagggtacccgtattctcgttgttgaagctcgcggcgtaggagcagaagacgttatctgtaaggaaaagatgtgtcccgtaatgtgcgccctcagctacaagcacttcgaagaaggtgtagaaatcgcacgtacgaacctcgccaacgaaggtaacggccacacctgtgctatccactccaacaatcaggcacacatcatcctcgcaggatcagagctgacggtatctcgtatcgtagtgaatgctccgagtgccactacagcaggcggtcacatccaaaacggtcttgccgtaaccaatacgctcggatgcggatcatggggtaataactctatctccgagaacttcacttacaagcacctcctcaacatttcacgcatcgcaccgttgaattcaagcattcacatccccgatgacaaagaaatctgggaactctaa

SEQ ID NO: 52 - protein, 451 aa, Porphyromonas gingivalis
MEIKEMVSLARKAQKEYQATHNQEAVDNICRAAAKVIYENAAILAREAVDETGMGVYEHKVAKNQGKSKGVWYNLHNKKSIGILNIDERTGMIEIAKPIGVVGAVTPTTNPIVTPMSNIIFALKTCNAIIIAPHPRSKKCSAHAVRLIKEAIAPFNVPEGMVQIIEEPSIEKTQELMGAVDVVVATGGMGMVKSAYSSGKPSFGVGAGNVQVIVDSNIDFEAAAEKIITGRAFDNGIICSGEQSIIYNEADKEAVFTAFRNHGAYFCDEAEGDRARAAIFENGAIAKDVVGQSVAFIAKKANINIPEGTRILVVEARGVGAEDVICKEKMCPVMCALSYKHFEEGVEIARTNLANEGNGHTCAIHSNNQAHIILAGSELTVSRIVVNAPSATTAGGHIQNGLAVTNTLGCGSWGNNSISENFTYKHLLNISRIAPLNSSIHIPDDKEIWEL

SEQ ID NO: 53 - DNA, 1116 bp, Porphyromonas gingivalis
atgcaacttttcaaactcaagagtgtaacacatcactttgacacttttgcagaatttgccaaggaattctgtcttggagaacgcgacttggtaattaccaacgagttcatctatgaaccgtatatgaaggcatgccagctcccctgccattttgttatgcaggagaaatatgggcaaggcgagccttctgacgaaatgatgaataacatcttggcagacatccgtaatatccagttcgaccgcgtaatcggtatcggaggaggtacggttattgacatctctaaacttttcgttctgaaaggattaaatgatgtactcgatgcattcgaccgcaaaatacctcttatcaaagagaaagaactgatcattgtgcccacaacatgcggaacgggtagcgaggtgacgaacatttctatcgcagaaatcaaaagccgtcacaccaaaatgggattggctgacgatgccattgttgcagaccatgccatcatcatacctgaacttctgaagagcttgcctttccacttctacgcatgcagtgcaatcgatgctcttatccatgccatcgagtcatacgtatctcctaaagccagtccatattctcgtctgttcagtgaggcggcttgggacattatcctggaagtattcaagaaaatcgccgaacacggccctgaataccgcttcgaaaagctgggagaaatgatcatggccagcaactatgccggtatagccttcggaaatgcaggagtaggagccgtccacgcactatcctacccgttgggaggcaactatcacgtgccgcatggagaagcaaactatcagttcttcacagaggtattcaaagtataccaaaagaagaatcctttcggctatatagtcgaactcaactggaagctctccaagatactgaactgccagcccgaatacgtatatccgaagctggatgaacttctcggatgccttcttaccaagaaacctttgcacgaatacggcatgaaggacgaagaggtaagaggctttgcggaatcagtgcttaagacacagcaaagattgctcgccaacaactacgtagagcttactgtagatgagatcgaaggtatctacagaagactctactaa

SEQ ID NO: 54 - protein, 371 aa, Porphyromonas gingivalis
MQLFKLKSVTHHFDTFAEFAKEFCLGERDLVITNEFIYEPYMKACQLPCHFVMQEKYGQGEPSDEMMNNILADIRNIQFDRVIGIGGGTVIDISKLFVLKGLNDVLDAFDRKIPLIKEKELIIVPTTCGTGSEVTNISIAEIKSRHTKMGLADDAIVADHAIIIPELLKSLPFHFYACSAIDALIHAIESYVSPKASPYSRLFSEAAWDIILEVFKKIAEHGPEYRFEKLGEMIMASNYAGIAFGNAGVGAVHALSYPLGGNYHVPHGEANYQFFTEVFKVYQKKNPFGYIVELNWKLSKILNCQPEYVYPKLDELLGCLLTKKPLHEYGMKDEEVRGFAESVLKTQQRLLANNYVELTVDEIEGIYRRLY

SEQ ID NO: 55 - DNA, 1296 bp, Porphyromonas gingivalis
atgaaagacgtattagcggaatatgcctcccgaattgtttcggccgaagaagccgtaaaacatatcaaaaatggagaacgggtagctttgtcacatgctgccggagttcctcagagttgtgttgatgcactggtacaacaggccgaccttttccagaatgtcgaaatttatcacatgctttgtctcggcgaaggaaaatatatggcacctgaaatggcccctcacttccgacacataaccaattttgtaggtggtaattctcgtaaagcagttgaggaaaatagagccgacttcattccggtattcttttatgaagtgccatcaatgattcgcaaagacatccttcacatagatgtcgccatcgttcagctttcaatgcctgatgagaatggttactgtagttttggagtatcttgcgattatagcaaaccggcagcagaaagcgctcatttagttataggggaaatcaaccgtcaaatgccatatgtacatggcgacaacttgattcacatatcgaagttggattacatcgtgatggcagactaccctatctattctcttgcaaagcccaaaatcggagaagtagaagaagctatcgggcgtaattgtgccgagcttattgaagatggtgccacactccaactcggtatcggcgcgattcctgatgcagccctgttattcctcaaggacaaaaaagatctggggatccataccgagatgttctccgatggtgttgtcgaattagttcgcagtggagtaattacaggaaagaaaaagacacttcaccccggaaagatggtcgcaaccttcttaatgggaagcgaagacgtatatcatttcatcgacaaaaatcccgatgtagaactttatccggtagattacgtcaatgatccgcgagtaatcgctcaaaatgataatatggtcagcatcaatagctgtatcgaaatcgatcttatgggacaagtcgtgtccgaatgtataggaagcaagcaattcagcggaaccggcggtcaagtagattatgttcgtggagcagcatggtctaaaaacggcaaaagcatcatggcaattccctcaacagccaaaaacggtactgcatctcgaattgtacctataattgcagagggagctgctgtaacaaccctccgcaacgaagtcgattacgttgtaaccgaatacggtatagcacaactcaaaggaaagagtttgcgccagcgagcagaagctcttattgccatagcccacccggatttcagagaggaactaacgaaacatctccgcaaacgtttcggataa

SEQ ID NO: 56 - protein, 431 aa, Porphyromonas gingivalis
MKDVLAEYASRIVSAEEAVKHIKNGERVALSHAAGVPQSCVDALVQQADLFQNVEIYHMLCLGEGKYMAPEMAPHFRHITNFVGGNSRKAVEENRADFIPVFFYEVPSMIRKDILHIDVAIVQLSMPDENGYCSFGVSCDYSKPAAESAHLVIGEINRQMPYVHGDNLIHISKLDYIVMADYPIYSLAKPKIGEVEEAIGRNCAELIEDGATLQLGIGAIPDAALLFLKDKKDLGIHTEMFSDGVVELVRSGVITGKKKTLHPGKMVATFLMGSEDVYHFIDKNPDVELYPVDYVNDPRVIAQNDNMVSINSCIEIDLMGQVVSECIGSKQFSGTGGQVDYVRGAAWSKNGKSIMAIPSTAKNGTASRIVPIIAEGAAVTTLRNEVDYVVTEYGIAQLKGKSLRQRAEALIAIAHPDFREELTKHLRKRFG

SEQ ID NO: 57 - DNA, 906 bp, Clostridium acetobutylicum
atgattaagagttttaatgaaattatcatgaaggtaaagagcaaagaaatgaaaaaagttgctgttgctgtagcacaagacgagccagtacttgaagcagtaagagatgctaagaaaaatggtattgcagatgctattcttgttggagaccatgacgaaatcgtgtcaatcgcgcttaaaataggaatggatgtaaatgattttgaaatagtaaacgagcctaacgttaagaaagctgctttaaaggcagtagagcttgtatcaactggaaaagctgatatggtaatgaagggacttgtaaatacagcaactttcttaagatctgtattaaacaaagaagttggacttagaacaggaaaaactatgtctcacgttgcagtatttgaaactgagaaatttgatagactattatttttaacagatgttgctttcaatacttatcctgaattaaaggaaaaaattgatatagtaaacaattcagttaaggttgcacatgcaataggaattgaaaatccaaaggttgctccaatttgtgcagttgaggttataaaccctaaaatgccatcaacacttgatgcagcaatgctttcaaaaatgagtgacagaggacaaattaaaggttgtgtagttgacggacctttagcacttgatatagctttatcagaagaagcagcacatcataagggagtaacaggagaagttgctggaaaagctgatatcttcttaatgccaaacatagaaacaggaaatgtaatgtataagactttaacatatacaactgattcaaaaaatggaggaatcttagttggaacttctgcaccagttgttttaacttcaagagctgacagccatgaaacaaaaatgaactctatagcacttgcagctttagttgcaggcaataaataa

SEQ ID NO: 58 - protein, 301 aa, Clostridium acetobutylicum
MIKSFNEIIMKVKSKEMKKVAVAVAQDEPVLEAVRDAKKNGIADAILVGDHDEIVSIALKIGMDVNDFEIVNEPNVKKAALKAVELVSTGKADMVMKGLVNTATFLRSVLNKEVGLRTGKTMSHVAVFETEKFDRLLFLTDVAFNTYPELKEKIDIVNNSVKVAHAIGIENPKVAPICAVEVINPKMPSTLDAAMLSKMSDRGQIKGCVVDGPLALDIALSEEAAHHKGVTGEVAGKADIFLMPNIETGNVMYKTLTYTTDSKNGGILVGTSAPVVLTSRADSHETKMNSIALAALVAGNK

SEQ ID NO: 59 - DNA, 1068 bp, Clostridium acetobutylicum
atgtatagattactaataatcaatcctggctcgacctcaactaaaattggtatttatgacgatgaaaaagagatatttgagaagactttaagacattcagctgaagagatagaaaaatataacactatatttgatcaatttcaattcagaaagaatgtaattttagatgcgttaaaagaagcaaacatagaagtaagttctttaaatgctgtagttggaagaggcggactcttaaagccaatagtaagtggaacttatgcagtaaatcaaaaaatgcttgaagaccttaaagtaggagttcaaggtcagcatgcgtcaaatcttggtggaattattgcaaatgaaatagcaaaagaaataaatgttccagcatacatagttgatccagttgttgtggatgagcttgatgaagtttcaagaatatcaggaatggctgacattccaagaaaaagtatattccatgcattaaatcaaaaagcagttgctagaagatatgcaaaagaagttggaaaaaaatacgaagatcttaatttaatcgtagtccacatgggtggaggtacttcagtaggtactcataaagatggtagagtaatagaagttaataatacacttgatggagaaggtccattctcaccagaaagaagtggtggagttccaataggagatcttgtaagattgtgcttcagcaacaaatatacttatgaagaagtaatgaaaaagataaacggcaaaggcggagttgttagttacttaaatactatcgattttaaggctgtagttgataaagctcttgaaggagataagaaatgtgcacttatatatgaagctttcacattccaggtagcaaaagagataggaaaatgttcaaccgttttaaaaggaaatgtagatgcaataatcttaacaggcggaattgcgtacaacgagcatgtatgtaatgccatagaggatagagtaaaattcatagcacctgtagttagatatggtggagaagatgaacttcttgcacttgcagaaggtggacttagagttttaagaggagaagaaaaagctaaggaatacaaataa

SEQ ID NO: 60 - protein, 355 aa, Clostridium acetobutylicum
MYRLLIINPGSTSTKIGIYDDEKEIFEKTLRHSAEEIEKYNTIFDQFQFRKNVILDALKEANIEVSSLNAVVGRGGLLKPIVSGTYAVNQKMLEDLKVGVQGQHASNLGGIIANEIAKEINVPAYIVDPVVVDELDEVSRISGMADIPRKSIFHALNQKAVARRYAKEVGKKYEDLNLIVVHMGGGTSVGTHKDGRVIEVNNTLDGEGPFSPERSGGVPIGDLVRLCFSNKYTYEEVMKKINGKGGVVSYLNTIDFKAVVDKALEGDKKCALIYEAFTFQVAKEIGKCSTVLKGNVDAIILTGGIAYNEHVCNAIEDRVKFIAPVVRYGGEDELLALAEGGLRVLRGEEKAKEYK

SEQ ID NO: 61 - DNA, 906 bp, Artificial Sequence
  Description of Artificial Sequence: Synthetic polynucleotide
atgattaagagttttaatgaaattatcatgaaggtaaagagcaaagaaatgaaaaaagttgctgttgctgtagcacaagacgagccagtacttgaagcagtacgcgatgctaagaaaaatggtattgcagatgctattcttgttggcgaccatgacgaaatcgtgtcaatcgcgcttaaaataggcatggatgtaaatgattttgaaatagtaaacgagcctaacgttaagaaagctgctttaaaggcagtagagctggtatcaactggaaaagctgatatggtaatgaagggacttgtaaatacagcaactttcttacgctctgtattaaacaaagaagttggactgagaacaggaaaaactatgtctcacgttgcagtatttgaaactgagaaatttgatcgtctgttatttttaacagatgttgctttcaatacttatcctgaattaaaggaaaaaattgatatcgtaaacaattcagttaaggttgcacatgcaataggtattgaaaatccaaaggttgctccaatttgtgcagttgaggttataaaccctaaaatgccatcaacacttgatgcagcaatgctttcaaaaatgagtgacagaggacaaattaaaggttgtgtagttgacggaccgttagcacttgatatcgctttatcagaagaagcagcacatcataagggcgtaacaggagaagttgctggaaaagctgatatcttcttaatgccaaacattgaaacaggaaatgtaatgtataagactttaacatatacaactgatagcaaaaatggcggaatcttagttggaacttctgcaccagttgttttaacttcacgcgctgacagccatgaaacaaaaatgaactctattgcacttgcagctttagttgcaggcaataaataa

SEQ ID NO: 62 - DNA, 906 bp, Artificial Sequence
  Description of Artificial Sequence: Synthetic polynucleotide
atgattaagagttttaatgaaattatcatgaaggtaaagagcaaagaaatgaaaaaagttgctgttgctgtagcacaagacgagccagtacttgaagcagtacgcgatgctaagaaaaatggtattgccgatgctattctggttggcgaccatgacgaaatcgtgtctatcgcgctgaaaataggcatggatgtaaatgattttgaaattgttaacgagcctaacgttaagaaagctgcgttaaaggcagtagagctggtatcaactggaaaagctgatatggtaatgaagggactggtaaataccgcaactttcttacgctctgtattaaacaaagaagttggtctgcgtacaggaaaaaccatgtctcacgttgcagtatttgaaactgagaaatttgatcgtctgttatttttaacagatgttgctttcaatacttatcctgaattaaaggaaaaaattgatatcgttaacaatagcgttaaggttgcacatgccattggtattgaaaatccaaaggttgctccaatttgtgcagttgaggttattaacccgaaaatgccatcaacacttgatgcagcaatgctttcaaaaatgagtgaccgcggacaaattaaaggttgtgtagttgacggaccgctggcacttgatatcgctttatcagaagaagcagcacatcataaaggcgtaacaggagaagttgctggaaaagctgatatcttcttaatgccaaacattgaaacaggaaatgtaatgtataagacgttaacctataccactgatagcaaaaatggcggcatcctggttggaacttctgcaccagttgttttaacttcacgcgctgacagccatgaaacaaaaatgaactctattgcactggcagcgctggttgcaggcaataaataa

SEQ ID NO: 63 - DNA, 906 bp, Artificial Sequence
  Description of Artificial Sequence: Synthetic polynucleotide
atgattaagagttttaatgaaattatcatgaaggtaaagagcaaagaaatgaaaaaagttgctgttgctgttgcacaagacgagccggtactggaagcggtacgcgatgctaagaaaaatggtattgccgatgctattctggttggcgaccatgacgaaatcgtctctatcgcgctgaaaattggcatggatgttaatgattttgaaattgttaacgagcctaacgttaagaaagctgcgctgaaggcggtagagctggtttccaccggaaaagctgatatggtaatgaaagggctggtgaataccgcaactttcttacgcagcgtactgaacaaagaagttggtctgcgtaccggaaaaaccatgagtcacgttgcggtatttgaaactgagaaatttgatcgtctgctgtttctgaccgatgttgctttcaatacttatcctgaattaaaagaaaaaattgatatcgttaacaatagcgttaaggttgcgcatgccattggtattgaaaatccaaaggttgctccaatttgtgcagttgaggttattaacccgaaaatgccatcaacacttgatgccgcaatgcttagcaaaatgagtgaccgcggacaaattaaaggttgtgtggttgacggcccgctggcactggatatcgcgttaagcgaagaagcggcacatcataaaggcgtaaccggcgaagttgctggaaaagctgatatcttcctgatgccaaacattgaaacaggcaatgtaatgtataaaacgttaacctataccactgatagcaaaaatggcggcatcctggttggaacttctgcaccagttgttttaacctcacgcgctgacagccatgaaaccaaaatgaacagcattgcactggcagcgctggttgcaggcaataaataa

SEQ ID NO: 64 - DNA, 906 bp, Artificial Sequence
  Description of Artificial Sequence: Synthetic polynucleotide
atgattaaaagttttaacgaaattatcatgaaagtgaaaagcaaagagatgaaaaaagtggcggttgcggttgcgcaggatgaaccggtgctggaagcggtgcgcgatgccaaaaaaaacggtattgccgatgccattctggtgggcgatcacgatgaaattgtctctattgcgctgaaaattggcatggatgttaacgattttgaaattgttaatgaaccgaacgtgaaaaaagcggcgctgaaagcggttgaactggtttccaccggtaaagccgatatggtgatgaaagggctggtgaataccgcaaccttcctgcgcagcgtgctgaataaagaagtgggtctgcgtaccggtaaaaccatgagtcatgttgcggtgtttgaaaccgaaaaatttgaccgtctgctgtttctgaccgatgttgcgtttaatacctatccggaactgaaagagaaaattgatatcgttaataacagcgtgaaagtggcgcatgccattggtattgaaaacccgaaagtggcgccgatttgcgcggttgaagtgattaacccgaaaatgccgtcaacgctggatgccgcgatgctcagcaaaatgagcgatcgcggtcaaatcaaaggctgtgtggttgatggcccgctggcgctggatatcgcgcttagcgaagaagcggcgcatcataaaggcgtgaccggcgaagtggccggtaaagccgatattttcctgatgccgaatattgaaaccggcaacgtgatgtataaaacgctgacctataccaccgacagcaaaaacggcggcattctggtgggtaccagcgcgccggtggtgctgacctcgcgcgccgacagccatgaaaccaaaatgaacagcattgcgctggcggcgctggtggccggtaataaataa

SEQ ID NO: 65 - DNA, 1068 bp, Artificial Sequence
  Description of Artificial Sequence: Synthetic polynucleotide
atgtatcgtttactgattatcaatcctggctcgacctcaactaaaattggtatttatgacgatgaaaaagagatatttgagaagactttacgtcattcagctgaagagatagaaaaatataacactatatttgatcaatttcagttcagaaagaatgtaattctcgatgcgttaaaagaagcaaacattgaagtaagttctttaaatgctgtagttggacgcggcggactgttaaagccaatagtaagtggaacttatgcagtaaatcaaaaaatgcttgaagaccttaaagtaggcgttcaaggtcagcatgcgtcaaatcttggtggaattattgcaaatgaaatagcaaaagaaataaatgttccagcatacatcgttgatccagttgttgtggatgagcttgatgaagtttcacgtatatcaggaatggctgacattccacgtaaaagtatattccatgcattaaatcaaaaagcagttgctagacgctatgcaaaagaagttggaaaaaaatacgaagatcttaatttaatcgtggtccacatgggtggcggtacttcagtaggtactcataaagatggtagagtaattgaagttaataatacacttgatggagaaggtccattctcaccagaaagaagtggtggcgttccaataggcgatcttgtacgtttgtgcttcagcaacaaatatacttatgaagaagtaatgaaaaagataaacggcaaaggcggcgttgttagttacttaaatactatcgattttaaggctgtagttgataaagctcttgaaggcgataagaaatgtgcacttatatatgaagctttcacattccaggtagcaaaagagataggaaaatgttcaaccgttttaaaaggaaatgtagatgcaataatcttaacaggcggaattgcgtacaacgagcatgtatgtaatgccatagaggatagagtaaaattcattgcacctgtagttcgttatggtggagaagatgaacttcttgcacttgcagaaggtggactgcgcgttttacgcggagaagaaaaagctaaggaatacaaataa

SEQ ID NO: 66 - DNA, 1068 bp, Artificial Sequence
  Description of Artificial Sequence: Synthetic polynucleotide
atgtatcgtttactgattatcaatcctggctcgacctcaactaaaattggtatttatgacgatgaaaaagagatatttgagaagacgttacgtcattcagctgaagagattgaaaaatataacactatatttgatcaatttcagttccgcaagaatgtgattctcgatgcgttaaaagaagcaaacattgaagtcagttctttaaatgctgtagttggacgcggcggactgttaaagccaattgtcagtggaacttatgcagtaaatcaaaaaatgcttgaagaccttaaagtgggcgttcaaggtcagcatgccagcaatcttggtggcattattgccaatgaaatcgcaaaagaaatcaatgttccagcatacatcgttgatccggttgttgtggatgagcttgatgaagttagccgtataagcggaatggctgacattccacgtaaaagtatattccatgcattaaatcaaaaagcagttgctcgtcgctatgcaaaagaagttggtaaaaaatacgaagatcttaatttaatcgtggtccacatgggtggcggtacttcagtaggtactcataaagatggtcgcgtgattgaagttaataatacacttgatggcgaaggtccattctcaccagaacgtagtggtggcgttccaattggcgatctggtacgtttgtgcttcagcaacaaatatacttatgaagaagtgatgaaaaagataaacggcaaaggcggcgttgttagttacctgaatactatcgattttaaggctgtagttgataaagcgcttgaaggcgataagaaatgtgcactgatttatgaagctttcaccttccaggtagcaaaagagattggtaaatgttcaaccgttttaaaaggaaatgttgatgccattatcttaacaggcggcattgcttacaacgagcatgtatgtaatgccattgaggatcgcgtaaaattcattgcacctgtagttcgttatggtggcgaagatgaactgctggcactggcagaaggtggactgcgcgttttacgcggcgaagaaaaagcgaaggaatacaaataa

SEQ ID NO: 67 - DNA, 1068 bp, Artificial Sequence
  Description of Artificial Sequence: Synthetic polynucleotide
atgtatcgtctgctgattatcaatcctggctcgacctcaactaaaattggtatttatgacgatgaaaaagagatatttgagaaaacgttacgtcatagcgctgaagagattgaaaaatataacactatttttgatcaatttcagttccgcaagaatgtgattctcgatgcgctgaaagaagcaaacattgaagtcagttcgctgaatgcggtagttggtcgcggcggtctgctgaagccaattgtcagcggcacttatgcggtaaatcaaaaaatgctggaagacctgaaagtgggcgttcaggggcagcatgccagcaatcttggtggcattattgccaatgaaatcgccaaagaaatcaatgttccggcatacatcgttgatccggttgttgtggatgagctggatgaagttagccgtatcagcggaatggctgacattccacgtaaaagtattttccatgcactgaatcaaaaagcggttgcgcgtcgctatgcaaaagaagttggtaaaaaatacgaagatcttaatctgatcgtggtgcatatgggtggcggtactagcgtcggtactcataaagatggtcgcgtgattgaagttaataatacacttgatggcgaaggtccattctcaccagaacgtagcggtggcgttccaattggcgatctggtacgtttgtgcttcagcaacaaatatacctatgaagaagtgatgaaaaagataaacggcaaaggcggcgttgttagttacctgaatactatcgattttaaggcggtagttgataaagcgctggaaggcgataagaaatgtgcactgatttatgaagcgttcaccttccaggtggcaaaagagattggtaaatgttcaaccgttctgaaaggcaatgttgatgccattatcctgaccggcggcattgcttacaacgagcatgtttgtaatgccattgaggatcgcgtaaaattcattgcacctgtggttcgttatggtggcgaagatgaactgctggcactggcagaaggtggtctgcgcgttttacgcggcgaagaaaaagcgaaagaatacaaataa

SEQ ID NO: 68 - DNA, 1068 bp, Artificial Sequence
  Description of Artificial Sequence: Synthetic polynucleotide
atgtatcgtctgctgattatcaacccgggcagcacctcaaccaaaattggtatttacgacgatgaaaaagagatttttgaaaaaacgctgcgtcacagcgcagaagagattgaaaaatacaacaccattttcgatcagttccagttccgcaaaaacgtgattctcgatgcgctgaaagaagccaatattgaagtctcctcgctgaatgcggtggtcggtcgcggcggtctgctgaaaccgattgtcagcggcacttatgcggttaatcagaaaatgctggaagatctgaaagtgggcgtgcaggggcagcatgccagcaatctcggcggcattatcgccaatgaaatcgccaaagagatcaacgtgccggcttatatcgtcgatccggtggtggttgatgaactggatgaagtcagccgtatcagcggcatggcggatattccgcgtaaaagcattttccatgcgctgaatcagaaagcggttgcgcgtcgctatgccaaagaagtgggtaaaaaatatgaagatctcaatctgattgtggtgcatatgggcggcggcaccagcgtcggtacgcataaagatggtcgcgtgattgaagtgaataacacgctggatggcgaagggccgttctcgccggaacgtagcggcggcgtgccgattggcgatctggtgcgtctgtgtttcagcaataaatacacctacgaagaagtgatgaaaaaaatcaacggcaaaggcggcgtggttagctatctgaataccatcgattttaaagcggtggttgataaagcgctggaaggcgataaaaaatgcgcgctgatttatgaagcgtttaccttccaggtggcgaaagagattggtaaatgttcaaccgtgctgaaaggcaacgttgatgccattattctgaccggcggcattgcttataacgaacatgtttgtaatgccattgaagatcgcgtgaaatttattgcgccggtggtgcgttacggcggcgaagatgaactgctggcgctggcggaaggcggtctgcgcgtgctgcgcggcgaagaaaaagcgaaagagtacaaataa

SEQ ID NO: 69 - DNA, 1407 bp, Clostridium biejerinckii
atgaataaagacacactaatacctacaactaaagatttaaaagtaaaaacaaatggtgaaaacattaatttaaagaactacaaggataattcttcatgtttcggagtattcgaaaatgttgaaaatgctataagcagcgctgtacacgcacaaaagatattatcccttcattatacaaaagagcaaagagaaaaaatcataactgagataagaaaggccgcattacaaaataaagaggtcttggctacaatgattctagaagaaacacatatgggaagatatgaggataaaatattaaaacatgaattggtagctaaatatactcctggtacagaagatttaactactactgcttggtcaggtgataatggtcttacagttgtagaaatgtctccatatggtgttataggtgcaataactccttctacgaatccaactgaaactgtaatatgtaatagcataggcatgatagctgctggaaatgctgtagtatttaacggacacccatgcgctaaaaaatgtgttgcctttgctgttgaaatgataaataaggcaattatttcatgtggcggtcctgaaaatctagtaacaactataaaaaatccaactatggagtctctagatgcaattattaagcatccttcaataaaacttctttgcggaactgggggtccaggaatggtaaaaaccctcttaaattctggtaagaaagctataggtgctggtgctggaaatccaccagttattgtagatgatactgctgatatagaaaaggctggtaggagcatcattgaaggctgttcttttgataataatttaccttgtattgcagaaaaagaagtatttgtttttgagaatgttgcagatgatttaatatctaacatgctaaaaaataatgctgtaattataaatgaagatcaagtatcaaaattaatagatttagtattacaaaaaaataatgaaactcaagaatactttataaacaaaaaatgggtaggaaaagatgcaaaattattcttagatgaaatagatgttgagtctccttcaaatgttaaatgcataatctgcgaagtaaatgcaaatcatccatttgttatgacagaactcatgatgccaatattgccaattgtaagagttaaagatatagatgaagctattaaatatgcaaagatagcagaacaaaatagaaaacatagtgcctatatttattctaaaaatatagacaacctaaatagatttgaaagagaaatagatactactatttttgtaaagaatgctaaatcttttgctggtgttggttatgaagcagaaggatttacaactttcactattgctggatctactggtgagggaataacctctgcaaggaattttacaagacaaagaagatgtgtacttgccggctaa

SEQ ID NO: 70 - protein, 468 aa, Clostridium biejerinckii
MNKDTLIPTTKDLKVKTNGENINLKNYKDNSSCFGVFENVENAISSAVHAQKILSLHYTKEQREKIITEIRKAALQNKEVLATMILEETHMGRYEDKILKHELVAKYTPGTEDLTTTAWSGDNGLTVVEMSPYGVIGAITPSTNPTETVICNSIGMIAAGNAVVFNGHPCAKKCVAFAVEMINKAIISCGGPENLVTTIKNPTMESLDAIIKHPSIKLLCGTGGPGMVKTLLNSGKKAIGAGAGNPPVIVDDTADIEKAGRSIIEGCSFDNNLPCIAEKEVFVFENVADDLISNMLKNNAVIINEDQVSKLIDLVLQKNNETQEYFINKKWVGKDAKLFLDEIDVESPSNVKCIICEVNANHPFVMTELMMPILPIVRVKDIDEAIKYAKIAEQNRKHSAYIYSKNIDNLNRFEREIDTTIFVKNAKSFAGVGYEAEGFTTFTIAGSTGEGITSARNFTRQRRCVLAG

SEQ ID NO: 71 - DNA, 1407 bp, Artificial Sequence
  Description of Artificial Sequence: Synthetic polynucleotide
atgaataaagacacactaatacctacaactaaagatttaaaagtaaaaacaaatggtgaaaacattaatttaaagaactacaaggataattcttcatgtttcggcgtattcgaaaatgttgaaaatgctataagcagcgctgtacacgcacaaaagatattatcccttcattatacaaaagagcaacgtgaaaaaatcataactgagataagaaaggccgcattacaaaataaagaggtcttggctacaatgattctggaagaaacacatatgggacgttatgaggataaaatattaaaacatgaattggtagctaaatatactcctggtacagaagatttaactactactgcctggtcaggtgataatggtctgacagttgtagaaatgtctccatatggtgttattggtgcaataactccttctacgaatccaactgaaactgtaatatgtaatagcataggcatgattgctgctggaaatgctgtagtatttaacggacacccatgcgctaaaaaatgtgttgcctttgctgttgaaatgataaataaggcaattatttcatgtggcggtcctgaaaatctggtaacaactataaaaaatccaaccatggagtctctggatgcaattattaagcatccttcaataaaacttctttgcggaactgggggtccaggaatggtaaaaaccctgttaaattctggtaagaaagctataggtgctggtgctggaaatccaccagttattgtcgatgatactgctgatatagaaaaggctggtcgtagcatcattgaaggctgttcttttgataataatttaccttgtattgcagaaaaagaagtatttgtttttgagaatgttgcagatgatttaatatctaacatgctaaaaaataatgctgtaattataaatgaagatcaagtatcaaaattaatcgatttagtattacaaaaaaataatgaaactcaagaatactttataaacaaaaaatgggtaggaaaagatgcaaaattattcctcgatgaaatagatgttgagtctccttcaaatgttaaatgcataatctgcgaagtaaatgcaaatcatccatttgttatgacagaactgatgatgccaatattgccaattgtacgcgttaaagatatcgatgaagctattaaatatgcaaagatagcagaacaaaatagaaaacatagtgcctatatttattctaaaaatatcgacaacctgaatcgctttgaacgtgaaatagatactactatttttgtaaagaatgctaaatcttttgctggtgttggttatgaagcagaaggatttacaactttcactattgctggatctactggtgagggaataacctctgcacgtaattttacacgccaacgtcgctgtgtacttgccggctaa

SEQ ID NO: 72 - DNA, 1407 bp, Artificial Sequence
  Description of Artificial Sequence: Synthetic polynucleotide
atgaataaagacacactgatccctacaactaaagatttaaaagtaaaaacaaatggtgaaaacattaatttaaagaactacaaagataatagcagttgtttcggcgtattcgaaaatgttgaaaatgctatcagcagcgctgtacacgcacaaaagatattatcgctgcattatacaaaagagcaacgtgaaaaaatcatcactgagatacgtaaggccgcattacaaaataaagaggtgctggctacaatgattctggaagaaacacatatgggacgttatgaggataaaatattaaaacatgaactggtagctaaatatactcctggtacagaagatttaactactactgcctggagcggtgataatggtctgacagttgtagaaatgtctccatatggtgttattggtgcaataactccttctaccaatccaactgaaactgtaatttgtaatagcattggcatgattgctgctggaaatgctgtagtatttaacggacacccatgcgctaaaaaatgtgttgcctttgctgttgaaatgatcaataaggcaattattagctgtggcggtccggaaaatctggtaacaactataaaaaatccaaccatggagtctctggatgccattattaagcatccttcaataaaactgctttgcggaactggcggtccaggaatggtaaaaaccctgttaaattctggtaagaaagctattggtgctggtgctggaaatccaccagttattgtcgatgatactgctgatattgaaaaggctggtcgtagcatcattgaaggctgttcttttgataataatttaccttgtattgcagaaaaagaagtatttgtttttgagaatgttgcagatgatttaatatctaacatgctgaaaaataatgctgtaattatcaatgaagatcaggtatcaaaattaatcgatttagtattacaaaaaaataatgaaactcaagaatactttatcaacaaaaaatgggtaggtaaagatgcaaaattattcctcgatgaaatcgatgttgagtctccttcaaatgttaaatgcattatctgcgaagtgaatgccaatcatccatttgttatgacagaactgatgatgccaatattgccaattgtgcgcgttaaagatatcgatgaagctattaaatatgcaaagattgcagaacaaaatagaaaacatagtgcctatatttatagcaaaaatatcgacaacctgaatcgctttgaacgtgaaatcgatactactatttttgtaaagaatgctaaatcttttgctggtgttggttatgaagcagaaggatttaccactttcactattgctggatctactggtgagggcataacctctgcacgtaattttacccgccaacgtcgctgtgtactggccggctaa

SEQ ID NO: 73 - DNA, 1407 bp, Artificial Sequence
  Description of Artificial Sequence: Synthetic polynucleotide
atgaataaagacacgctgatcccgacaactaaagatctgaaagtaaaaaccaatggtgaaaacattaatctgaagaactacaaagataatagcagttgtttcggcgtattcgaaaatgttgaaaatgctatcagcagcgcggtacacgcacaaaagatactctcgctgcattataccaaagagcaacgtgaaaaaatcatcactgagatccgtaaggccgcattacaaaataaagaggtgctggcaacaatgattctggaagaaacacatatgggacgttatgaggataaaatactgaaacatgaactggtggcgaaatatacgcctggtactgaagatttaaccaccactgcctggagcggtgataatggtctgaccgttgtggaaatgtcgccttatggtgttattggtgcaattacgccttcaaccaatccaactgaaacggtaatttgtaatagcattggcatgattgctgctggaaatgcggtagtatttaacggtcacccctgcgctaaaaaatgtgttgcctttgctgttgaaatgatcaataaagcgattattagctgtggcggtccggaaaatctggtaaccactataaaaaatccaaccatggagtcgctggatgccattattaagcatccttcaatcaaactgctgtgcggcactggcggtccaggaatggtgaaaaccctgctgaatagcggtaagaaagcgattggtgctggtgctggaaatccaccagttattgtcgatgatactgctgatattgaaaaagcgggtcgtagcatcattgaaggctgttcttttgataataatttaccttgtattgcagaaaaagaagtatttgtttttgagaatgttgccgatgatctgatctctaacatgctgaaaaataatgcggtgattatcaatgaagatcaggttagcaaactgatcgatctggtattacaaaaaaataatgaaactcaagaatactttatcaacaaaaaatgggtaggtaaagatgcaaaactgttcctcgatgaaatcgatgttgagtcgccttcaaatgttaaatgcattatctgcgaagtgaatgccaatcatccatttgtgatgaccgaactgatgatgccaattttgccgattgtgcgcgttaaagatatcgatgaagcgattaaatatgcaaagattgcagaacaaaatcgtaaacatagtgcctatatttatagcaaaaatatcgacaacctgaatcgctttgaacgtgaaatcgataccactatttttgtgaagaatgctaaatcttttgctggtgttggttatgaagcagaaggttttaccactttcactattgctggaagcaccggtgaaggcattacctctgcacgtaattttacccgccaacgtcgctgtgtactggccggctaa

SEQ ID NO: 74 - DNA, 1407 bp, Artificial Sequence
  Description of Artificial Sequence: Synthetic polynucleotide
atgaataaagatacgctgatcccgaccaccaaagatctgaaagtgaaaaccaacggcgaaaatatcaacctgaaaaactataaagataacagcagttgctttggcgtgtttgaaaacgttgaaaacgccatctccagcgcggtgcatgcgcaaaaaattctctcgctgcattacaccaaagagcagcgtgaaaaaattatcaccgaaatccgtaaagcggcgctgcaaaacaaagaagtgctggcaaccatgatcctggaagaaacgcatatggggcgttatgaagataaaattctgaaacatgaactggtggcgaaatacacgccgggcactgaagatctgaccaccaccgcctggagcggcgataacggcctgaccgtggtggagatgtcgccttatggcgtgattggcgcgattacgccgtcaaccaacccgaccgaaacggtgatttgtaacagcattggcatgattgccgcgggtaatgcggtggtgtttaacggtcatccctgcgcgaaaaaatgtgtggcgtttgccgttgagatgatcaacaaagcgattatcagctgcggcggcccggaaaatctggtgaccaccatcaaaaatccgaccatggaatcgctggatgccattatcaaacatccttccatcaaactgctgtgcggcaccggcggcccgggcatggtgaaaacgctgctgaacagcggtaaaaaagcgattggcgcgggcgcgggtaacccgccggtgattgtcgatgacaccgccgatattgaaaaagcggggcgtagcattattgaaggctgttcttttgataacaacctgccctgcattgccgaaaaagaagtgtttgtctttgaaaacgtcgccgatgatctgatcagcaatatgctgaaaaacaacgcggtgattatcaatgaagatcaggttagcaaactgatcgatctggtgctgcaaaaaaacaacgaaacgcaggaatattttatcaacaaaaaatgggttggtaaagatgccaaactgtttctcgatgaaatcgatgttgaatcgccgtctaacgtgaaatgtattatctgcgaagtgaacgccaaccatccgtttgtgatgaccgaactgatgatgccgattctgccgattgtgcgcgtgaaagatatcgatgaagcgattaaatatgccaaaattgccgaacaaaaccgtaaacacagcgcctatatttacagcaaaaatatcgataacctgaaccgctttgaacgtgaaatcgataccaccatttttgtgaaaaatgccaaaagttttgccggcgttggttatgaagcggaaggttttaccacctttaccattgccggtagcaccggcgaaggcattaccagcgcccgtaattttacccgccagcgtcgctgcgtgctggcgggctaa

SEQ ID NO: 75 - DNA, 1023 bp, Geobacillus thermoglucosidasius
atgaaagctgcagtagtagagcaatttaaggaaccattaaaaattaaagaagtggaaaagccatctatttcatatggcgaagtattagtccgcattaaagcatgcggtgtatgccatacggacttgcacgccgctcatggcgattggccagtaaaaccaaaacttcctttaatccctggccatgaaggagtcggaattgttgaagaagtcggtccgggggtaacccatttaaaagtgggagaccgcgttggaattccttggttatattctgcgtgcggccattgcgaatattgtttaagcggacaagaagcattatgtgaacatcaacaaaacgccggctactcagtcgacgggggttatgcagaatattgcagagctgcgccagattatgtggtgaaaattcctgacaacttatcgtttgaagaagctgctcctattttctgcgccggagttactacttataaagcgttaaaagtcacaggtacaaaaccgggagaatgggtagcgatctatggcatcggcggccttggacatgttgccgtccagtatgcgaaagcgatggggcttcatgttgttgcagtggatatcggcgatgagaaactggaacttgcaaaagagcttggcgccgatcttgttgtaaatcctgcaaaagaaaatgcggcccaatttatgaaagagaaagtcggcggagtacacgcggctgttgtgacagctgtatctaaacctgcttttcaatctgcgtacaattctatccgcagaggcggcacgtgcgtgcttgtcggattaccgccggaagaaatgcctattccaatctttgatacggtattaaacggaattaaaattatcggttccattgtcggcacgcggaaagacttgcaagaagcgcttcagttcgctgcagaaggtaaagtaaaaaccattattgaagtgcaacctcttgaaaaaattaacgaagtatttgacagaatgctaaaaggagaaattaacggacgggttgttttaacgttagaaaataataattaa

SEQ ID NO: 76 - protein, 340 aa, Geobacillus thermoglucosidasius
MKAAVVEQFKEPLKIKEVEKPSISYGEVLVRIKACGVCHTDLHAAHGDWPVKPKLPLIPGHEGVGIVEEVGPGVTHLKVGDRVGIPWLYSACGHCEYCLSGQEALCEHQQNAGYSVDGGYAEYCRAAPDYVVKIPDNLSFEEAAPIFCAGVTTYKALKVTGTKPGEWVAIYGIGGLGHVAVQYAKAMGLHVVAVDIGDEKLELAKELGADLVVNPAKENAAQFMKEKVGGVHAAVVTAVSKPAFQSAYNSIRRGGTCVLVGLPPEEMPIPIFDTVLNGIKIIGSIVGTRKDLQEALQFAAEGKVKTIIEVQPLEKINEVFDRMLKGEINGRVVLTLENNN

SEQ ID NO: 77 - DNA, 4090 bp, Artificial Sequence
  Description of Artificial Sequence: Synthetic polynucleotide
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaaaataccgacggatagaacgacccggtggtggttagggtattacttcacataccctatggatttctgggtgcagcaaggtagcaagcgccagaatccccaggagcttacataagtaagtgactggggtgagggcgtgaagctaacgccgctgcggcctgaaagacgacgggtatgaccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacacccttggcggtgtttgtctgaacgtgggttgtatcccttctaaagcgctgctgcacgtggcaaaagttatcgaagaagcgaaagcgctggccgaacacggcatcgttttcggcgaaccgaaaactgacattgacaagatccgcacctggaaagaaaaagtcatcactcagctgaccggtggtctggctggcatggccaaaggtcgtaaagtgaaggtggttaacggtctgggtaaatttaccggcgctaacaccctggaagtggaaggcgaaaacggcaaaaccgtgatcaacttcgacaacgccatcatcgcggcgggttcccgtccgattcagctgccgtttatcccgcatgaagatccgcgcgtatgggactccaccgacgcgctggaactgaaatctgtaccgaaacgcatgctggtgatgggcggcggtatcatcggtctggaaatgggtaccgtataccatgcgctgggttcagagattgacgtggtggaaatgttcgaccaggttatcccggctgccgacaaagacgtggtgaaagtcttcaccaaacgcatcagcaagaaatttaacctgatgctggaagccaaagtgactgccgttgaagcgaaagaagacggtatttacgtttccatggaaggtaaaaaagcaccggcggaagcgcagcgttacgacgcagtgctggtcgctatcggccgcgtaccgaatggtaaaaacctcgatgcaggtaaagctggcgtggaagttgacgatcgcggcttcatccgcgttgacaaacaaatgcgcaccaacgtgccgcacatctttgctatcggcgatatcgtcggtcagccgatgctggcgcacaaaggtgtccatgaaggccacgttgccgcagaagttatctccggtctgaaacactacttcgatccgaaagtgatcccatccatcgcctacactaaaccagaagtggcatgggtcggtctgaccgagaaagaagcgaaagagaaaggcatcagctacgaaaccgccaccttcccgtgggctgcttccggccgtgctatcgcttctgactgcgcagatggtatgaccaaactgatcttcgacaaagagacccaccgtgttatcggcggcgcgattgtcggcaccaacggcggcgagctgctgggtgagatcggcctggctatcgagatgggctgtgacgctgaagacatcgccctgaccatccacgctcacccgactctgcacgagtccgttggcctggcggcggaagtgttcgaaggcagcatcaccgacctgccaaacgccaaagcgaagaaaaagtaactttttctttcaggaaaaaagcataagcggctccgggagccgctttttttatgcctgatgtttagaactatgtcactgttcataaaccgctacacctcatacatactttaagggcgaattctgcagatatccatcacactggcggccgctcgagcatgcatctagcacatccggcaattaaaaaagcggctaaccacgccgctttttttacgtctgcaatttacctttccagtcttcttgctccacgttcagagagacgttcgcatactgctgaccgttgctcgttattcagcctgacagtatggttactgtcgtttagacgttgtgggcggctctcctgaactttctcccgaaaaacctgacgttgttcaggtgatgccgattgaacacgctggcgggcgttatcacgttgctgttgattcagtgggcgctgctgtactttttcctt

SEQ ID NO: 78 - protein, 475 aa, Escherichia coli
MMSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 79 - protein, 475 aa, Klebsiella pneumoniae
MMSTEIKTQVVVLGAGPAGYSAAFRCADLGLETVIVERYSTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKSVPKRMLVMGGGIIGLEMGTVYHALGSEIDVVEMFDQVIPAADKDVVKVFTKRISKKFNLMLEAKVTAVEAKEDGIYVSMEGKKAPAEAQRYDAVLVAIGRVPNGKNLDAGKAGVEVDDRGFIRVDKQMRTNVPHIFAIGDIVGQPMLAHKGVHEGHVAAEVISGLKHYFDPKVIPSIAYTKPEVAWVGLTEKEAKEKGISYETATFPWAASGRAIASDCADGMTKLIFDKETHRVIGGAIVGTNGGELLGEIGLAIEMGCDAEDIALTIHAHPTLHESVGLAAEVFEGSITDLPNAKAKKK

SEQ ID NO: 80 - DNA, 347 bp, Artificial Sequence
  Description of Artificial Sequence: Synthetic polynucleotide
ataataatacatatgaaccatgcgagttacgggcctataagccaggcgagatatgatctatatcaatttctcatctataatgctttgttagtatctcgtcgccgacttaataaagagagagttagtgtgaaagctgacaacccttttgatcttttacttcctgctgcaatggccaaagtggccgaagaggcgggtgtctataaagcaacgaaacatccgcttaagactttctatctggcgattaccgccggtgttttcatctcaatcgcattcaccactggcacaggcacagaaggtaggtgttacatgtcagaacgtttacacaatgacgtggatcctattattat

SEQ ID NO: 81 - DNA, 4678 bp, Artificial Sequence
  Description of Artificial Sequence: Synthetic polynucleotide
aagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttaagccaggcgagatatgatctatatcaatttctcatctataatgctttgttagtatctcgtcgccgacttaataaagagagagttagtcttctatatcacagcaagaaggtaggtgttacatgatgagtactgaaatcaaaactcaggtcgtggtacttggggcaggccccgcaggttactctgcagccttccgttgcgctgatttaggtctggaaaccgtcatcgtagaacgttacagcaccctcggtggtgtttgtctgaacgtgggttgtatcccttctaaagcgctgctgcacgtggcaaaagttatcgaagaagcgaaagcgctggccgaacacggcatcgttttcggcgaaccgaaaactgacattgacaagatccgcacctggaaagaaaaagtcatcactcagctgaccggtggtctggctggcatggccaaaggtcgtaaagtgaaggtggttaacggtctgggtaaatttaccggcgctaacaccctggaagtggaaggcgaaaacggcaaaaccgtgatcaacttcgacaacgccatcatcgcggcgggttcccgtccgattcagctgccgtttatcccgcatgaagatccgcgcgtatgggactccaccgacgcgctggaactgaaatctgtaccgaaacgcatgctggtgatgggcggcggtatcatcggtctggaaatgggtaccgtataccatgcgctgggttcagagattgacgtggtggaaatgttcgaccaggttatcccggctgccgacaaagacgtggtgaaagtcttcaccaaacgcatcagcaagaaatttaacctgatgctggaagccaaagtgactgccgttgaagcgaaagaagacggtatttacgtttccatggaaggtaaaaaagcaccggcggaagcgcagcgttacgacgcagtgctggtcgctatcggccgcgtaccgaatggtaaaaacctcgatgcaggtaaagctggcgtggaagttgacgatcgcggcttcatccgcgttgacaaacaaatgcgcaccaacgtgccgcacatctttgctatcggcgatatcgtcggtcagccgatgctggcgcacaaaggtgtccatgaaggccacgttgccgcagaagttatctccggtctgaaacactacttcgatccgaaagtgatcccatccatcgcctacactaaaccagaagtggcatgggtcggtctgaccgagaaagaagcgaaagagaaaggcatcagctacgaaaccgccaccttcccgtgggctgcttccggccgtgctatcgcttctgactgcgcagatggtatgaccaaactgatcttcgacaaagagacccaccgtgttatcggcggcgcgattgtcggcaccaacggcggcgagctgctgggtgagatcggcctggctatcgagatgggctgtgacgctgaagacatcgccctgaccatccacgctcacccgactctgcacgagtccgttggcctggcggcggaagtgttcgaaggcagcatcaccgacctgccaaacgccaaagcgaagaaaaagtaactttttctttcaggaaaaaagcataagcggctccgggagccgctttttttatgcctgatgtttagaactatgtcactgttcataaaccgctacacctcatacatactttaagggcgaattctgcagatatccatcacactggcggccgctcgagcatgcatctagcacatccggcaattaaaaaagcggctaaccacgccgctttttttacgtctgcaatttacctttccagtcttcttgctccacgttcagagagacgttcgcatactgctgaccgttgctcgttattcagcctgacagtatggttactgtcgtttagacgttgtgggcggctctcctgaactttctcccgaaaaacctgacgttgttcaggtgatgccgattgaacacgctggcgggcgttatcacgttgctgttgattcagtgggcgctgctgtactttttccttaaacacctggcgctgctctggtgatgcggactgaatacgctcacgcgctgcgtctcttcgctgctggttctgcgggttagtctgcattttctcgcgaaccgcctggcgctgctcaggcgaggcggactgaatgcgctcacgcgctgcctctcttcgctgctggatcttcgggttagtctgcattctctcgcgaactgcctggcgctgctcaggcgaggcggactgataacgctgacgagcggcgtccttttgttgctgggtcagtggttggcgacggctgaagtcgtggaagtcgtcatagctcccatagtgttcagcttcattaaaccgctgtgccgctgcctgacgttgggtacctcgtgtaatgactggtgcggcgtgtgttcgttgctgaaactgatttgctgccgcctgacgctggctgtcgcgcgttggggcaggtaattgcgtggcgctcattccgccgttgacatcggtttgatgaaaccgctttgccatatcctgatcatgatagggcacaccattacggtagtttggattgtgccgccatgccatattcttatcagtaagatgctcaccggtgatacggttgaaattgttgacgtcgatattgatgttgtcgccgttgtgttgccagccattaccgtcacgatgaccgccatcgtggtgatgataatcat

SEQ ID NO: 82 - DNA, 1114 bp, Artificial Sequence
  Description of Artificial Sequence: Synthetic polynucleotide
  CDS (323)..(958)
caaaaaaccggagtctgtgctccggttttttattatccgctaatcaattacatatgaatatcctccttagttcctattccgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagatgcttaatgaatacaacagtactgcgatgagtggcagggcggggcgtaaggcgcgccatttaaatgaagttcctattccgaagttcctattctctagaaagtataggaacttcgaagcagctccagcctacacccttcttcagggctgactgtttgcataaaaattcatctgtatgcacaata

SEQ ID NO: 83 - protein, 212 aa, Artificial Sequence
  Description of Artificial Sequence: Synthetic polypeptide
MEKKITGYTTVDISQWHRKEHFEAFQSVAQCTYNQTVQLDITAFLKTVKKNKHKFYPAFIHILARLMNAHPELRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRCLMNTTVLR

SEQ ID NO: 84 - DNA, 2521 bp, Artificial Sequence
  Description of Artificial Sequence: Synthetic polynucleotide
ttatttggtgatattggtaccaatatcatgcagcaaacggtgcaacattgccgtgtctcgttgctctaaaagccccaggcgttgttgtaaccagtcgaccagttttatgtcatctgccactgccagagtcgtcagcaatgtcatggctcgttcgcgtaaagcttgcagttgatgttggtctgccgttgcatcacttttcgccggttgttgtattaatgttgctaattgatagcaatagaccatcaccgcctgccccagattgagcgaaggataatccgccaccatcggcacaccagtaagaacgtcagccaacgctaactcttcgttagtcaacccggaatcttcgcgaccaaacaccagcgcggcatggctcatccatgaagatttttcctctaacagcggcaccagttcaactggcgtggcgtagtaatgatatttcgcccgactgcgcgcagtggtggcgacagtgaaatcgacatcgtgtaacgattcagccaatgtcgggaaaactttaatattatcaataatatcaccagatccatgtgcgacccagcgggtggctggctccaggtgtgcctgactatcgacaatccgcagatcgctaaaccccatcgttttcattgcccgcgccgctgccccaatattttctgctctggcgggtgcgaccagaataatcgttatacgcatattgccactcttcttgatcaaataaccgcgaaccgggtgatcactgtcaacttattacgcggtgcgaatttacaaattcttaacgtaagtcgcagaaaaagccctttacttagcttaaaaaaggctaaactatttcctgactgtactaacggttgagttgttaaaaaatgctacatatccttctgtttacttaggataattttataaaaaataaatctcgacaattggattcaccacgtttattagttgtatgatgcaactagttggattattaaaataatgtgacgaaagctagcatttagatacgatgatttcatcaaactgttaacgtgctacaattgaacttgatatatgtcaacgaagcgtagttttattgggtgtccggcccctcttagcctgttatgttgctgttaaaatggttaggatgacagccgtttttgacactgtcgggtcctgagggaaagtacccacgaccaagctaatgatgttgttgacgttgatggaaagtgcatcaagaacgcaattacgtactttagtcatgttacgccgatcatgttaatttgcagcatgcatcaggcaggtcagggacttttgtacttcctgtttcgatttagttggcaatttaggtagcaaacgaattcatcggctttaccaccgtcaaaaaaaacggcgctttttagcgccgtttttatttttcaaccttatttccagatacgtaactcatcgtccgttgtaacttctttactggctttcattttcggcagtgaaaacgcataccagtcgatattacgggtcacaaacatcatgccggccagcgccaccaccagcacactggttcccaacaacagcgcgctatcggcagagttgagcagtccccacatcacaccatccagcaacaacagcgcgagggtaaacaacatgctgttgcaccaacctttcaataccgcttgcaaataaataccgttcattatcgccccaatcagactggcgattatccatgccacggtaaaaccggtatgttcagaaagcgccagcaagagcaaataaaacatcaccaatgaaagccccaccagcaaatattgcattgggtgtaaacgttgcgcggtgagcgtttcaaaaacaaagaacgccataaaagtcagtgcaatcagcagaatggcgtacttagtcgcccggtcagttaattggtattgatcggctggcgtcgttactgcgacgctaaacgccgggaagttttcccagccggtatcattgcctgaagcaaaacgctcaccgagattattagcaaaccagctgctttgccagtgcgcctgaaaacctgactcgctaacttcccgtttggctggtagaaaatcacctaaaaaactgggatgcggccagttgctggttaaggtcatttcgctattacgcccgccaggcaccacagaaagatcgccggtaccgcttaaattcagggccatattcagcttcaggttctgcttccgccagtccccttcaggtaaagggatatgcacgccctgcccgccttgctctaacccggtgccgggttcaatggtcagcgccgttccgttaacttcaggcgctttcaccacaccaataccacgcgcatccccgacgctaatcacaataaatggcttgcctaaggtgatatttggcgcgttgagttcgctaagacgcgaaacatcgaaatcggcttttaacgttaaatcactgtgccagacctgaccggtataaatccctatcttgcgttcttccacgttctgattgccatcaaccatcaatgactcaggtaaccaaaaatggataaaacttcgtttccgctgcagggttttat

SEQ ID NO: 85 - DNA, 3010 bp, Artificial Sequence
  Description of Artificial Sequence: Synthetic polynucleotide
aagccacagcaggatgcccactgcaacaaaggtgatcacaccggaaacgcgatggagaatggacgctatcgccgtgatggggaaccggatggtctgtaggtccagattaacaggtctttgttttttcacatttcttatcatgaataacgcccacatgctgttcttattattccctggggactacgggcacagaggttaactttctgttacctggagacgtcgggatttccttcctccggtctgcttgcgggtcagacagcgtcctttctataactgcgcgtcatgcaaaacactgcttccagatgcgaaaacgacacgttacaacgctgggtggctcgggattgcagggtgttccggagacctggcggcagtataggctgttcacaaaatcattacaattaacctacatatagtttgtcgggttttatcctgaacagtgatccaggtcacgataacaacatttatttaatttttaatcatctaatttgacaatcattcaacaaagttgttacaaacattaccaggaaaagcatataatgcgtaaaagttatgaagtcggtatttcacctaagattaacttatgtaacagtgtggaagtattgaccaattcattcgggacagttattagtggtagacaagtttaataattcggattgctaagtacttgattcgccatttattcgtcatcaatggatcctttacctgcaagcgcccagagctctgtacccaggttttcccctctttcacagagcggcgagccaaataaaaaacgggtaaagccaggttgatgtgcgaaggcaaatttaagttccggcagtcttacgcaataaggcgctaaggagaccttaaatggctgatacaaaagcaaaactcaccctcaacggggatacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcggcgttctatcacgactcgctggatgttaacaatcctcgtcaccgtgaaattgccgcgttcctcctgctgtcgaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctctacctccaccgtgcgtaccgctggctcttcgggtgcgaacccgtttgcctgtatcgcagcaggtattgcttcactgtggggacctgcgcacggcggtgctaacgaagcggcgctgaaaatgctggaagaaatcagctccgttaaacacattccggaatttgttcgtcgtgcgaaagacaaaaatgattctttccgcctgatgggcttcggtcaccgcgtgtacaaaaattacgacccgcgcgccaccgtaatgcgtgaaacctgccatgaagtgctgaaagagctgggcacgaaggatgacctgctggaagtggctatggagctggaaaacatcgcgctgaacgacccgtactttatcgagaagaaactgtacccgaacgtcgatttctactctggtatcatcctgaaagcgatgggtattccgtcttccatgttcaccgtcattttcgcaatggcacgtaccgttggctggatcgcccactggagcgaaatgcacagtgacggtatgaagattgcccgtccgcgtcagctgtatacaggatatgaaaaacgcgactttaaaagcgatatcaagcgttaatggttgattgctaagttgtaaatattttaacccgccgttcatatggcgggttgatttttatatgcctaaacacaaaaaattgtaaaaataaaatccattaacagacctatatagatatttaaaaagaatagaacagctcaaattatcagcaacccaatactttcaattaaaaacttcatggtagtcgcatttataaccctatgaaaatgacgtctatctatacccccctatattttattcatcatacaacaaattcatgataccaataatttagttttgcatttaataaaactaacaatatttttaagcaaaactaaaaactagcaataatcaaatacgatattctggcgtagctatacccctattctatatccttaaaggactctgttatgtttaaaggacaaaaaacattggccgcactggccgtatctctgctgttcactgcacctgtttatgctgctgatgaaggttctggcgaaattcactttaagggggaggttattgaagcaccttgtgaaattcatccagaagatattgataaaaacatagatcttggacaagtcacgacaacccatataaaccgggagcatcatagcaataaagtggccgtcgacattcgcttgatcaactgtgatctgcctgcttctgacaacggtagcggaatgccggtatccaaagttggcgtaaccttcgatagcacggctaagacaactggtgctacgcctttgttgagcaacaccagtgcaggcgaagcaactggggtcggtgtacgactgatggacaaaaatgacggtaacatcgtattaggttcagccgcgccagatcttgacctggatgcaagctcatcagaacagacgctgaactttttcgcctggat

SEQ ID NO: 86 - DNA, 4180 bp, Artificial Sequence
  Description of Artificial Sequence: Synthetic polynucleotide
cgcgatgtcgacgtcacgaaactgaaaaaaccgctctacattctggcgactgctgatgaagaaaccagtatggccggagcgcgttattttgccgaaactaccgccctgcgcccggattgcgccatcattggcgaaccgacgtcactacaaccggtacgcgcacataaaggtcatatctctaacgccatccgtattcagggccagtcggggcactccagcgatccagcacgcggagttaacgctatcgaactaatgcacgacgccatcgggcatattttgcaattgcgcgataacctgaaagaacgttatcactacgaagcgtttaccgtgccataccctacgctcaacctcgggcatattcacggtggcgacgcttctaaccgtatttgcgcttgctgtgagttgcatatggatattcgtccgctgcctggcatgacactcaatgaacttaatggtttgctcaacgatgcattggctccggtgagcgaacgctggccgggtcgtctgacggtcgacgagctgcatccgccgatccctggctatgaatgcccaccgaatcatcaactggttgaagtggttgagaaattgctcggagcaaaaaccgaagtggtgaactactgtaccgaagcgccgtttattcaaacgttatgcccgacgctggtgttggggcctggctcaattaatcaggctcatcaacctgatgaatatctggaaacacggtttatcaagcccacccgcgaactgataacccaggtaattcaccatttttgctggcattaaaacgtaggccggataaggcgctcgcgccgcatccggcgctgttgccaaactccagtgccgcaataatgtcggatgcgatgcttgcgcatcttatccgacctacagtgactcaaacgatgcccaaccgtaggccggataaggcgctcgcgccgcatccggcactgttgccaaactccagtgccgcaataatgtcggatgcgatacttgcgcatcttatccgaccgacagtgactcaaacgatgcccaactgtaggccggataaggcgctcgcgccgcatccggcactgttgccaaactccagtgccgcaataatgtcggatgcgatacttgcgcatcttatccgacctacacctttggtgttacttggggcgattttttaacatttccataagttacgcttatttaaagcgtcgtgaatttaatgacgtaaattcctgctatttattcgtttgctgaagcgatttcgcagcatttgacgtcaccgcttttacgtggctttataaaagacgacgaaaagcaaagcccgagcatattcgcgccaatgctagcaagaggagaagtcgacatgacagacttaaataaagtggtaaaagaacttgaagctcttggtatttatgacgtaaaagaagttgtttacaatccaagctacgagcaattgttcgaagaagaaactaaaccaggtttagaaggctttgaaaaaggtactttaactacgactggtgcagtggcagtagatacaggtatcttcacaggtcgttctccaaaagataaatatatcgtgttagatgaaaaaaccaaagatactgtttggtggacatctgaaacagcaaaaaacgacaacaagccaatgaaccaagctacatggcaaagcttaaaagacttggtaaccaaccagctttctcgtaaacgcttatttgtagttgatggtttctgtggtgcgagcgaacacgaccgtattgcagtacgtattgtcactgaagtagcgtggcaagcacattttgtaaaaaatatgtttattcgcccaactgaagaacaactcaaaaattttgaaccagatttcgttgtaatgaatggttctaaagtaaccaatccaaactggaaagaacaaggtttaaattcagaaaactttgttgctttcaacttgactgaacgcattcaattaatcggtggtacttggtacggcggtgaaatgaaaaaaggtatgttctcaatcatgaactacttcctaccacttaaaggtgttggtgcaatgcactgctcagctaacgttggtaaagatggcgatgtagcaatcttcttcggcttatctggcacaggtaaaacaaccctttcaacggatccaaaacgtgaattaatcggtgacgatgaacacggctgggatgatgtgggtatctttaactttgaaggtggttgctatgcgaaaaccattcacctttcagaagaaaatgaaccagatatttaccgcgctatccgtcgcgacgcattattagaaaacgtggttgttcgtgcagatggttctgttgatttcgatgatggttcaaaaacagaaaatactcgcgtgtcttacccaatttatcacattgataacattgtaaaaccagtttctcgtgcaggtcacgcaactaaagtgattttcttaactgcagatgcatttggcgtattaccaccagtatctaaattgacaccagaacaaactaaatactacttcttatctggtttcacagcaaaattagcaggtactgaacgtggtattactgaaccaactccaactttctcagcatgtttcggtgctgcgttcttaacccttcacccaactcaatatgcagaagtgttagtaaaacgtatgcaagcagtgggtgctgaagcttacttagtaaatactggttggaatggcacaggcaaacgtatctcaatcaaagatactcgcggaatcattgatgcaatcttagatggctcaattgaaaaagctgaaatgggcgaattaccaatctttaacttagccattcctaaagcattaccaggtgtagattctgcaatcttagatcctcgcgatacttacgcagataaagcacaatggcaatcaaaagctgaagacttagcaggtcgttttgtgaaaaactttgttaaatatgcaactaacgaagaaggcaaagctttaattgcagctggtcctaaagcttaatctagaaagcttcctagaggcatcaaataaaacgaaaggctcagtcgaaagactgggcctttcgttttatctgttgtttgtcggtgaacgctctcctgagtaggacgaattcacttctgttctaacaccctcgttttcaatatatttctgtctgcattttattcaaattctgaatataccttcagatatccttaaggaattgtcgttacattcggcgatattttttcaagacaggttcttactatgcattccacagaagtccaggctaaacctctttttagctggaaagccctgggttgggcactgctctacttttggtttttctctactctgctacaggccattatttacatcagtggttatagtggcactaacggcattcgcgactcgctgttattcagttcgctgtggttgatcccggtattcctctttccgaagcggattaaaattattgccgcagtaatcggcgtggtgctatgggcggcctctctggcggcgctgtgctactacgtcatctacggtcaggagttctcgcagagcgttctgtttgtgatgttcgaaaccaacaccaacgaagccagcgagtatttaagccagtatttcagcctgaaaattgtgcttatcgcgctggcctatacggcggtggcagttctgctgtggacacgcctgcgcccggtctatattccaaagccgtggcgttatgttgtctcttttgccctgctttatggcttgattctgcatccgatcgccatgaatacgtttatcaaaaacaagccgtttgagaaaacgttggataacctggcctcgcgtatggagcctgccgcaccgtggcaattcctgaccggctattatcagtatcgtcagcaactaaactcgctaacaaagttactgaatgaaaataatgccttgccgccactggctaatttcaaagatgaatcgggtaacgaaccgcgcactttagtgctggtgattggcgagtcgacccagcgcggacgcatgagtctgtacggttatccgcgtgaaaccacgccggagctggatgcgctgcataaaaccgatccgaatctgaccgtgtttaataacgtagttacgtctcgtccgtacaccattgaaatcctgcaacaggcgctgacctttgccaatgaaaagaacccggatctgtatctgacgcagccgtcgctgatgaacatgatgaaacaggcgggttataaaaccttc

SEQ ID NO: 87 - DNA, 4960 bp, Artificial Sequence
  Description of Artificial Sequence: Synthetic polynucleotide
aataggcgtatcacgaggccctttcgtcttcacctcgagaattgtgagcggataacaattgacattgtgagcggataacaagatactgagcacatcagcaggacgcactgaccgaattcaattaagctagcaagaggagaagtcgagatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataatctagcaagaggagaagtcgacatggaaatcaaagaaatggtgagccttgcacgcaaggctcagaaggagtatcaagctacccataaccaagaagcagttgacaacatttgccgagctgcagcaaaagttatttatgaaaatgcagctattctggctcgcgaagcagtagacgaaaccggcatgggcgtttacgaacacaaagtggccaagaatcaaggcaaatccaaaggtgtttggtacaacctccacaataaaaaatcgattggtatcctcaatatagacgagcgtaccggtatgatcgagattgcaaagcctatcggagttgtaggagccgtaacgccgacgaccaacccgatcgttactccgatgagcaatatcatctttgctcttaagacctgcaatgccatcattattgccccccaccccagatccaaaaaatgctctgcacacgcagttcgtctgatcaaagaagctatcgctccgttcaacgtaccggaaggtatggttcagatcatcgaagaacccagcatcgagaagacgcaggaactcatgggcgccgtagacgtagtagttgctacgggtggtatgggcatggtgaagtctgcatattcttcaggaaagccttctttcggtgttggagccggtaacgttcaggtgatcgtggatagcaacatcgatttcgaagctgctgcagaaaaaatcatcaccggtcgtgctttcgacaacggtatcatctgctcaggcgaacagagcatcatctacaacgaggctgacaaggaagcagttttcacagcattccgcaaccacggtgcatatttctgtgacgaagccgaaggagatcgggctcgtgcagctatcttcgaaaatggagccatcgcgaaagatgtagtaggtcagagcgttgccttcattgccaagaaagcaaacatcaatatccccgagggtacccgtattctcgttgttgaagctcgcggcgtaggagcagaagacgttatctgtaaggaaaagatgtgtcccgtaatgtgcgccctcagctacaagcacttcgaagaaggtgtagaaatcgcacgtacgaacctcgccaacgaaggtaacggccacacctgtgctatccactccaacaatcaggcacacatcatcctcgcaggatcagagctgacggtatctcgtatcgtagtgaatgctccgagtgccactacagcaggcggtcacatccaaaacggtcttgccgtaaccaatacgctcggatgcggatcatggggtaataactctatctccgagaacttcacttacaagcacctcctcaacatttcacgcatcgcaccgttgaattcaagcattcacatccccgatgacaaagaaatctgggaactctaatctagcaagaggagaagtcgacatgcaacttttcaaactcaagagtgtaacacatcactttgacacttttgcagaatttgccaaggaattctgtcttggagaacgcgacttggtaattaccaacgagttcatctatgaaccgtatatgaaggcatgccagctcccctgccattttgttatgcaggagaaatatgggcaaggcgagccttctgacgaaatgatgaataacatcttggcagacatccgtaatatccagttcgaccgcgtaatcggtatcggaggaggtacggttattgacatctctaaacttttcgttctgaaaggattaaatgatgtactcgatgcattcgaccgcaaaatacctcttatcaaagagaaagaactgatcattgtgcccacaacatgcggaacgggtagcgaggtgacgaacatttctatcgcagaaatcaaaagccgtcacaccaaaatgggattggctgacgatgccattgttgcagaccatgccatcatcatacctgaacttctgaagagcttgcctttccacttctacgcatgcagtgcaatcgatgctcttatccatgccatcgagtcatacgtatctcctaaagccagtccatattctcgtctgttcagtgaggcggcttgggacattatcctggaagtattcaagaaaatcgccgaacacggccctgaataccgcttcgaaaagctgggagaaatgatcatggccagcaactatgccggtatagccttcggaaatgcaggagtaggagccgtccacgcactatcctacccgttgggaggcaactatcacgtgccgcatggagaagcaaactatcagttcttcacagaggtattcaaagtataccaaaagaagaatcctttcggctatatagtcgaactcaactggaagctctccaagatactgaactgccagcccgaatacgtatatccgaagctggatgaacttctcggatgccttcttaccaagaaacctttgcacgaatacggcatgaaggacgaagaggtaagaggctttgcggaatcagtgcttaagacacagcaaagattgctcgccaacaactacgtagagcttactgtagatgagatcgaaggtatctacagaagactctactaatctagaaagcttcctagaggcatcaaataaaacgaaaggctcagtcgaaagactgggcctttcgttttatctgttgtttgtcggtgaacgctctcctgagtaggacaaatccgccgccctagacctaggcgttcggctgcgacacgtcttgagcgattgtgtaggctggagctgcttcgaagttcctatactttctagagaataggaacttcggaataggaactaaggaggatattcatatggaccatggctaattcccat

SEQ ID NO: 88 - DNA, 5083 bp, Artificial Sequence
  Description of Artificial Sequence: Synthetic polynucleotide
tcgagaaatttatcaaaaagagtgttgacttgtgagcggataacaatgatacttagattcaattgtgagcggataacaatttcacacagaattcaattaagctagcaagaggagaagtcgacatggccaacataagttcaccattcgggcaaaacgaatggctggttgaagagatgtaccgcaagttccgcgacgacccctcctcggtcgatcccagctggcacgagttcctggttgactacagccccgaacccacctcccaaccagctgccgaaccaacccgggttacctcgccactcgttgccgagcgggccgctgcggccgccccgcaggcaccccccaagccggccgacaccgcggccgcgggcaacggcgtggtcgccgcactggccgccaaaactgccgttcccccgccagccgaaggtgacgaggtagcggtgctgcgcggcgccgccgcggccgtcgtcaagaacatgtccgcgtcgttggaggtgccgacggcgaccagcgtccgggcggtcccggccaagctactgatcgacaaccggatcgtcatcaacaaccagttgaagcggacccgcggcggcaagatctcgttcacgcatttgctgggctacgccctggtgcaggcggtgaagaaattcccgaacatgaaccggcactacaccgaagtcgacggcaagcccaccgcggtcacgccggcgcacaccaatctcggcctggcgatcgacctgcaaggcaaggacgggaagcgttccctggtggtggccggcatcaagcggtgcgagaccatgcgattcgcgcagttcgtcacggcctacgaagacatcgtacgccgggcccgcgacggcaagctgaccactgaagactttgccggcgtgacgatttcgctgaccaatcccggaaccatcggcaccgtgcattcggtgccgcggctgatgcccggccagggcgccatcatcggcgtgggcgccatggaataccccgccgagtttcaaggcgccagcgaggaacgcatcgccgagctgggcatcggcaaattgatcactttgacctccacctacgaccaccgcatcatccagggcgcggaatcgggcgacttcctgcgcaccatccacgagttgctgctctcggatggcttctgggacgaggtcttccgcgaactgagcatcccatatctgccggtgcgctggagcaccgacaaccccgactcgatcgtcgacaagaacgctcgcgtcatgaacttgatcgcggcctaccgcaaccgcggccatctgatggccgataccgacccgctgcggttggacaaagctcggttccgcagtcaccccgacctcgaagtgctgacccacggcctgacgctgtgggatctcgatcgggtgttcaaggtcgacggctttgccggtgcgcagtacaagaaactgcgcgacgtgctgggcttgctgcgcgatgcctactgccgccacatcggcgtggagtacgcccatatcctcgaccccgaacaaaaggagtggctcgaacaacgggtcgagaccaagcacgtcaaacccactgtggcccaacagaaatacatcctcagcaagctcaacgccgccgaggcctttgaaacgttcctacagaccaagtacgtcggccagaagcggttctcgctggaaggcgccgaaagcgtgatcccgatgatggacgcggcgatcgaccagtgcgctgagcacggcctcgacgaggtggtcatcgggatgccgcaccggggccggctcaacgtgctggccaacatcgtcggcaagccgtactcgcagatcttcaccgagttcgagggcaacctgaatccgtcgcaggcgcacggctccggtgacgtcaagtaccacctgggcgccaccgggctgtacctgcagatgttcggcgacaacgacattcaggtgtcgctgaccgccaacccgtcgcatctggaggccgtcgacccggtgctggagggattggtgcgggccaagcaggatctgctcgaccacggaagcatcgacagcgacggccaacgggcgttctcggtggtgccgctgatgttgcatggcgatgccgcgttcgccggtcagggtgtggtcgccgagacgctgaacctggcgaatctgccgggctaccgcgtcggcggcaccatccacatcatcgtcaacaaccagatcggcttcaccaccgcgcccgagtattccaggtccagcgagtactgcaccgacgtcgcaaagatgatcggggcaccgatctttcacgtcaacggcgacgacccggaggcgtgtgtctgggtggcgcggttggcggtggacttccgacaacggttcaagaaggacgtcgtcatcgacatgctgtgctaccgccgccgcgggcacaacgagggtgacgacccgtcgatgaccaacccctacatgtacgacgtcgtcgacaccaagcgcggggcccgcaaaagctacaccgaagccctgatcggacgtggcgacatctcgatgaaggaggccgaggacgcgctgcgcgactaccagggccagctggaacgggtgttcaacgaagtgcgcgagctggagaagcacggtgtgcagccgagcgagtcggtcgagtccgaccagatgattcccgcggggctggccactgcggtggacaagtcgctgctggcccggatcggcgatgcgttcctcgccttgccgaacggcttcaccgcgcacccgcgagtccaaccggtgctggagaagcgccgggagatggcctatgaaggcaagatcgactgggcctttggcgagctgctggcgctgggctcgctggtggccgaaggcaagctggtgcgcttgtcggggcaggacagccgccgcggcaccttctcccagcggcattcggttctcatcgaccgccacactggcgaggagttcacaccactgcagctgctggcgaccaactccgacggcagcccgaccggcggaaagttcctggtctacgactcgccactgtcggagtacgccgccgtcggcttcgagtacggctacactgtgggcaatccggacgccgtggtgctctgggaggcgcagttcggcgacttcgtcaacggcgcacagtcgatcatcgacgagttcatcagctccggtgaggccaagtggggccaattgtccaacgtcgtgctgctgttaccgcacgggcacgaggggcagggacccgaccacacttctgcccggatcgaacgcttcttgcagttgtgggcggaaggttcgatgaccatcgcgatgccgtcgactccgtcgaactacttccacctgctacgccggcatgccctggacggcatccaacgcccgctgatcgtgttcacgcccaagtcgatgttgcgtcacaaggccgccgtcagcgaaatcaaggacttcaccgagatcaagttccgctcagtgctggaggaacccacctatgaggacggcatcggagaccgcaacaaggtcagccggatcctgctgaccagtggcaagctgtattacgagctggccgcccgcaaggccaaggacaaccgcaatgacctcgcgatcgtgcggcttgaacagctcgccccgctgcccaggcgtcgactgcgtgaaacgctggaccgctacgagaacgtcaaggagttcttctgggtccaagaggaaccggccaaccagggtgcgtggccgcgattcgggctcgaactacccgagctgctgcctgacaagttggccgggatcaagcgaatctcgcgccgggcgatgtcagccccgtcgtcaggctcgtcgaaggtgcacgccgtcgaacagcaggagatcctcgacgaggcgttcggctaatctagcaagaggagaagtcgacatgaagttattaaaattggcacctgatgtttataaatttgatactgcagaggagtttatgaaatactttaaggttggaaaaggtgactttatacttactaatgaatttttatataaacctttccttgagaaattcaatgatggtgcagatgctgtatttcaggagaaatatggactcggtgaaccttctgatgaaatgataaacaatataattaaggatattggagataaacaatataatagaattattgctgtagggggaggatctgtaatagatatagccaaaatcctcagtcttaagtatactgatgattcattggatttgtttgagggaaaagtacctcttgtaaaaaacaaagaattaattatagttccaactacatgtggaacaggttcagaagttacaaatgtatcagttgcagaattaaagagaagacatactaaaaaaggaattgcttcagacgaattatatgcaacttatgcagtacttgtaccagaatttataaaaggacttccatataagttttttgtaaccagctccgtagatgccttaatacatgcaacagaagcttatgtatctccaaatgcaaatccttatactgatatgtttagtgtaaaagctatggagttaattttaaatggatacatgcaaatggtagagaaaggaaatgattacagagttgaaataattgaggattttgttataggcagcaattatgcaggtatagcttttggaaatgcaggagtgggagcggttcacgcactctcatatccaataggcggaaattatcatgtgcctcatggagaagcaaattatctgttttttacagaaatatttaaaacttattatgagaaaaatccaaatggcaagattaaagatgtaaataaactattagcaggcatactaaaatgtgatgaaagtgaagcttatgacagtttatcacaacttttagataaattattgtcaagaaaaccattaagagaatatggaatgaaagaggaagaaattgaaacttttgctgattcagtaatagaaggacagcagagactgttggtaaacaattatgaacctttttcaagagaagacatagtaaacacatataaaaagttatattaatctagaaagcttcctagaggcatcaaataaaacgaaaggctcagtcgaaagactgggcctttcgttttatctgttgtttgtcggtgaacgctctcctgagtaggacaaatccgccgccctagaccta

SEQ ID NO: 89 - DNA, 5097 bp, Artificial Sequence
  Description of Artificial Sequence: Synthetic polynucleotide
tctgtatcaggctgaaaatcttctctcatccgccaaaacagcttcggcgttaagatgcgcgctcaaggacgtaagccgtcgactctcgccgtgctggcgcaggacacggctaccactcctttctctgttgatattctgcttgccattgagcaaaccgccagcgagttcggctggaatagttttttaatcaatattttttctgaagatgacgctgcccgcgcggcacgtcagctgcttgcccaccgtccggatggcattatctatactacaatggggctgcgacatatcacgctgcctgagtctctgtatggtgaaaatattgtattggcgaactgtgtggcggatgacccagcgttacccagttatatccctgatgattacactgcacaatatgaatcaacacagcatttgctcgcggcgggctatcgtcaaccgttatgcttctggctaccggaaagtgcgttggcaacagggtatcgtcggcagggatttgagcaggcctggcgtgatgctggacgagatctggctgaggtgaaacaatttcacatggcaacaggtgatgatcactacaccgatctcgcaagtttactcaatgcccacttcaaaccgggcaaaccagattttgatgttctgatatgtggtaacgatcgcgcagcctttgtggcttatcaggttcttctggcgaagggggtacgaatcccgcaggatgtcgccgtaatgggctttgataatctggttggcgtcgggcatctgtttttaccgccgctgaccacaattcagcttccacatgacattatcgggcgggaagctgcattgcatattattgaaggtcgtgaagggggaagagtgacgcggatcccttgcccgctgttgatccgttgttccacctgatattatgttaacccagtagccagagtgctccatgttgcagcacagccactccgtgggaggcataaagcgacagttcccgttcttctggctgcggatagattcgactactcatcaccgcttccccgtcgttaataaatacttccacggatgatgtatcgataaatatccttagggcgagcgtgtcacgctgcgggaggggaatactacggtagccgtctaaattctcgtgtgggtaataccgccacaaaacaagtcgctcagattggttatcaatatacagccgcattccagtgccgagctgtaatccgtaatgttcggcatcactgttcttcagcgcccactgcaactgaatctcaactgcttgcgcgttttcctgcaaaacatatttattgctgattgtgcggggagagacagattgatgctgctggcgtaacgactcagcttcgtgtaccgggcgttgtagaagtttgccattgctctctgatagctcgcgcgccagcgtcatgcagcctgcccatccttcacgttttgagggcattggcgattcccacatatccatccagccgataacaatacgccgaccatccttcgctaaaaagctttgtggtgcataaaagtcatgcccgttatcaagttcagtaaaatgcccggattgtgcaaaaagtcgtcctggcgaccacattccgggtattacgccactttgaaagcgatttcggtaactgtatccctcggcattcattccctgcggggaaaacatcagataatgctgatcgccaaggctgaaaaagtccggacattcccacatatagctttcacccgcatcagcgtgggccagtacgcgatcgaaggtccattcacgcaacgaactgccgcgataaagcaggatctgccccgtgttgcctggatctttcgccccgactaccatccaccatgtgtcggcttcacgccacactttaggatcgcggaagtgcatgattccttctggtggagtgaggatcacaccctgtttctcgaaatgaataccatcccgactggtagccagacattgtacttcgcgaattgcatcgtcattacctgcaccatcgagccagacgtgtccggtgtagataagtgagaggacaccattgtcatcgacagcactacctgaaaaacacccgtctttgtcattatcgtctcctggcgctagcgcaataggctcatgctgccagtggatcatatcgtcgctggtggcatgtccccagtgcattggcccccagtgttcgctcatcggatgatgttgataaaacgcgtgataacgatcgttaaaccagatcaggccgtttggatcgttcatccacccggcaggaggcgcgaggtgaaaatggggatagaaagtgttaccccggtgctcatgaagttttgctagggcgttttgcgccgcatgcaatcgagattgcgtcattttaatcatcctggttaagcaaatttggtgaattgttaacgttaacttttataaaaataaagtcccttactttcataaatgcgatgaatatcacaaatgttaacgttaactatgacgttttgtgatcgaatatgcatgttttagtaaatccatgacgattttgcgaaaaagaggtttatcactatgcgtaactcagatgaatttaagggaaaaaaatgtcagccaaagtatgggttttaggggatgcggtcgtagatctcttgccagaatcagacgggcgcctactgccttgtcctggcggcgcgccagctaacgttgcggtgggaatcgccagattaggcggaacaagtgggtttataggtcgggtgggggatgatccttttggtgcgttaatgcaaagaacgctgctaactgagggagtcgatatcacgtatctgaagcaagatgaatggcaccggacatccacggtgcttgtcgatctgaacgatcaaggggaacgttcatttacgtttatggtccgccccagtgccgatctttttttagagacgacagacttgccctgctggcgacatggcgaatggttacatctctgttcaattgcgttgtctgccgagccttcgcgtaccagcgcatttactgcgatgacggcgatccggcatgccggaggttttgtcagcttcgatcctaatattcgtgaagatctatggcaagacgagcatttgctccgcttgtgtttgcggcaggcgctacaactggcggatgtcgtcaagctctcggaagaagaatggcgacttatcagtggaaaaacacagaacgatcaggatatatgcgccctggcaaaagagtatgagatcgccatgctgttggtgactaaaggtgcagaaggggtggtggtctgttatcgaggacaagttcaccattttgctggaatgtctgtgaattgtgtcgatagcacgggggcgggagatgcgttcgttgccgggttactcacaggtctgtcctctacgggattatctacagatgagagagaaatgcgacgaattatcgatctcgctcaacgttgcggagcgcttgcagtaacggcgaaaggggcaatgacagcgctgccatgtcgacaagaactggaatagtgagaagtaaacggcgaagtcgctcttatctctaaataggacgtgaattttttaacgacaggcaggtaattatggcactgaatattccattcagaaatgcgtactatcgttttgcatccagttactcatttctcttttttatttcctggtcgctgtggtggtcgttatacgctatttggctgaaaggacatctagggttgacagggacggaattaggtacactttattcggtcaaccagtttaccagcattctatttatgatgttctacggcatcgttcaggataaactcggtctgaagaaaccgctcatctggtgtatgagtttcatcctggtcttgaccggaccgtttatgatttacgtttatgaaccgttactgcaaagcaatttttctgtaggtctaattctgggggcgctattttttggcttggggtatctggcgggatgcggtttgcttgatagcttcaccgaaaaaatggcgcgaaattttcatttcgaatatggaacagcgcgcgcctggggatcttttggctatgctattggcgcgttctttgccggcatattttttagtatcagtccccatatcaacttctggttggtctcgctatttggcgctgtatttatgatgatcaacatgcgttttaaagataaggatcaccagtgcgtagcggcagatgcgggaggggtaaaaaaagaggattttatcgcagttttcaaggatcgaaacttctgggttttcgtcatatttattgtggggacgtggtctttctataacatttttgatcaacaactttttcctgtcttttattcaggtttattcgaatcacacgatgtaggaacgcgcctgtatggttatctcaactcattccaggtggtactcgaagcgctgtgcatggcgattattcctttctttgtgaatcgggtagggccaaaaaatgcattacttatcggagttgtgattatggcgttgcgtatcctttcctgcgcgctgttcgttaacccctggattatttcattagtgaagttgttacatgccattgaggttccactttgtgtcatatccgtcttcaaatacagcgtggcaaactttgataagcgcctgtcgtcgacgatctttctgattggttttcaaattgccagttcgcttgggattgtgctgctttcaacgccgactgggatactctttgaccacgcaggctaccagacagttttcttcgcaatttcgggtattgtctgcctgatgttgctatttggcattttcttcttgagtaaaaaacgcgagcaaatagttatggaaacgcctgtaccttcagcaatatagacgtaaactttttccggttgttgtcgatagctctatatccctcaaccggaaaataataatagtaaaatgcttagccctgctaataatcgcctaatccaaacgcctcattcatgttctggtacagtcgctcaaatgtacttcagatgcgcggttcgctgatttccaggacattgtcgtcattcagtgacctgtcccgtgtatcacggtcctgcgaattcatcaaggaatgcattgcggagtgaagtatcgagtcacgccatatttcgtcacccgaagatgagttttgagatattaaggcaggtgactttcactcaca

SEQ ID NO: 90 - DNA, 3525 bp, Nocardia iowensis
atggcagtggattcaccggatgagcggctacagcgccgcattgcacagttgtttgcagaagatgagcaggtcaaggccgcacgtccgctcgaagcggtgagcgcggcggtgagcgcgcccggtatgcggctggcgcagatcgccgccactgttatggcgggttacgccgaccgcccggccgccgggcagcgtgcgttcgaactgaacaccgacgacgcgacgggccgcacctcgctgcggttacttccccgattcgagaccatcacctatcgcgaactgtggcagcgagtcggcgaggttgccgcggcctggcatcatgatcccgagaaccccttgcgcgcaggtgatttcgtcgccctgctcggcttcaccagcatcgactacgccaccctcgacctggccgatatccacctcggcgcggttaccgtgccgttgcaggccagcgcggcggtgtcccagctgatcgctatcctcaccgagacttcgccgcggctgctcgcctcgaccccggagcacctcgatgcggcggtcgagtgcctactcgcgggcaccacaccggaacgactggtggtcttcgactaccaccccgaggacgacgaccagcgtgcggccttcgaatccgcccgccgccgccttgccgacgcgggcagcttggtgatcgtcgaaacgctcgatgccgtgcgtgcccggggccgcgacttaccggccgcgccactgttcgttcccgacaccgacgacgacccgctggccctgctgatctacacctccggcagcaccggaacgccgaagggcgcgatgtacaccaatcggttggccgccacgatgtggcaggggaactcgatgctgcaggggaactcgcaacgggtcgggatcaatctcaactacatgccgatgagccacatcgccggtcgcatatcgctgttcggcgtgctcgctcgcggtggcaccgcatacttcgcggccaagagcgacatgtcgacactgttcgaagacatcggcttggtacgtcccaccgagatcttcttcgtcccgcgcgtgtgcgacatggtcttccagcgctatcagagcgagctggaccggcgctcggtggcgggcgccgacctggacacgctcgatcgggaagtgaaagccgacctccggcagaactacctcggtgggcgcttcctggtggcggtcgtcggcagcgcgccgctggccgcggagatgaagacgttcatggagtccgtcctcgatctgccactgcacgacgggtacgggtcgaccgaggcgggcgcaagcgtgctgctcgacaaccagatccagcggccgccggtgctcgattacaagctcgtcgacgtgcccgaactgggttacttccgcaccgaccggccgcatccgcgcggtgagctgttgttgaaggcggagaccacgattccgggctactacaagcggcccgaggtcaccgcggagatcttcgacgaggacggcttctacaagaccggcgatatcgtggccgagctcgagcacgatcggctggtctatgtcgaccgtcgcaacaatgtgctcaaactgtcgcagggcgagttcgtgaccgtcgcccatctcgaggccgtgttcgccagcagcccgctgatccggcagatcttcatctacggcagcagcgaacgttcctatctgctcgcggtgatcgtccccaccgacgacgcgctgcgcggccgcgacaccgccaccttgaaatcggcactggccgaatcgattcagcgcatcgccaaggacgcgaacctgcagccctacgagattccgcgcgatttcctgatcgagaccgagccgttcaccatcgccaacggactgctctccggcatcgcgaagctgctgcgccccaatctgaaggaacgctacggcgctcagctggagcagatgtacaccgatctcgcgacaggccaggccgatgagctgctcgccctgcgccgcgaagccgccgacctgccggtgctcgaaaccgtcagccgggcagcgaaagcgatgctcggcgtcgcctccgccgatatgcgtcccgacgcgcacttcaccgacctgggcggcgattccctttccgcgctgtcgttctcgaacctgctgcacgagatcttcggggtcgaggtgccggtgggtgtcgtcgtcagcccggcgaacgagctgcgcgatctggcgaattacattgaggcggaacgcaactcgggcgcgaagcgtcccaccttcacctcggtgcacggcggcggttccgagatccgcgccgccgatctgaccctcgacaagttcatcgatgcccgcaccctggccgccgccgacagcattccgcacgcgccggtgccagcgcagacggtgctgctgaccggcgcgaacggctacctcggccggttcctgtgcctggaatggctggagcggctggacaagacgggtggcacgctgatctgcgtcgtgcgcggtagtgacgcggccgcggcccgtaaacggctggactcggcgttcgacagcggcgatcccggcctgctcgagcactaccagcaactggccgcacggaccctggaagtcctcgccggtgatatcggcgacccgaatctcggtctggacgacgcgacttggcagcggttggccgaaaccgtcgacctgatcgtccatcccgccgcgttggtcaaccacgtccttccctacacccagctgttcggccccaatgtcgtcggcaccgccgaaatcgtccggttggcgatcacggcgcggcgcaagccggtcacctacctgtcgaccgtcggagtggccgaccaggtcgacccggcggagtatcaggaggacagcgacgtccgcgagatgagcgcggtgcgcgtcgtgcgcgagagttacgccaacggctacggcaacagcaagtgggcgggggaggtcctgctgcgcgaagcacacgatctgtgtggcttgccggtcgcggtgttccgttcggacatgatcctggcgcacagccggtacgcgggtcagctcaacgtccaggacgtgttcacccggctgatcctcagcctggtcgccaccggcatcgcgccgtactcgttctaccgaaccgacgcggacggcaaccggcagcgggcccactatgacggcttgccggcggacttcacggcggcggcgatcaccgcgctcggcatccaagccaccgaaggcttccggacctacgacgtgctcaatccgtacgacgatggcatctccctcgatgaattcgtcgactggctcgtcgaatccggccacccgatccagcgcatcaccgactacagcgactggttccaccgtttcgagacggcgatccgcgcgctgccggaaaagcaacgccaggcctcggtgctgccgttgctggacgcctaccgcaacccctgcccggcggtccgcggcgcgatactcccggccaaggagttccaagcggcggtgcaaacagccaaaatcggtccggaacaggacatcccgcatttgtccgcgccactgatcgataagtacgtcagcgatctggaactgcttcagctgctctaa

SEQ ID NO: 91 - protein, 1174 aa, Nocardia iowensis
MAVDSPDERLQRRIAQLFAEDEQVKAARPLEAVSAAVSAPGMRLAQIAATVMAGYADRPAAGQRAFELNTDDATGRTSLRLLPRFETITYRELWQRVGEVAAAWHHDPENPLRAGDFVALLGFTSIDYATLDLADIHLGAVTVPLQASAAVSQLIAILTETSPRLLASTPEHLDAAVECLLAGTTPERLVVFDYHPEDDDQRAAFESARRRLADAGSLVIVETLDAVRARGRDLPAAPLFVPDTDDDPLALLIYTSGSTGTPKGAMYTNRLAATMWQGNSMLQGNSQRVGINLNYMPMSHIAGRISLFGVLARGGTAYFAAKSDMSTLFEDIGLVRPTEIFFVPRVCDMVFQRYQSELDRRSVAGADLDTLDREVKADLRQNYLGGRFLVAVVGSAPLAAEMKTFMESVLDLPLHDGYGSTEAGASVLLDNQIQRPPVLDYKLVDVPELGYFRTDRPHPRGELLLKAETTIPGYYKRPEVTAEIFDEDGFYKTGDIVAELEHDRLVYVDRRNNVLKLSQGEFVTVAHLEAVFASSPLIRQIFIYGSSERSYLLAVIVPTDDALRGRDTATLKSALAESIQRIAKDANLQPYEIPRDFLIETEPFTIANGLLSGIAKLLRPNLKERYGAQLEQMYTDLATGQADELLALRREAADLPVLETVSRAAKAMLGVASADMRPDAHFTDLGGDSLSALSFSNLLHEIFGVEVPVGVVVSPANELRDLANYIEAERNSGAKRPTFTSVHGGGSEIRAADLTLDKFIDARTLAAADSIPHAPVPAQTVLLTGANGYLGRFLCLEWLERLDKTGGTLICVVRGSDAAAARKRLDSAFDSGDPGLLEHYQQLAARTLEVLAGDIGDPNLGLDDATWQRLAETVDLIVHPAALVNHVLPYTQLFGPNVVGTAEIVRLAITARRKPVTYLSTVGVADQVDPAEYQEDSDVREMSAVRVVRESYANGYGNSKWAGEVLLREAHDLCGLPVAVFRSDMILAHSRYAGQLNVQDVFTRLILSLVATGIAPYSFYRTDADGNRQRAHYDGLPADFTAAAITALGIQATEGFRTYDVLNPYDDGISLDEFVDWLVESGHPIQRITDYSDWFHRFETAIRALPEKQRQASVLPLLDAYRNPCPAVRGAILPAKEFQAAVQTAKIGPEQDIPHLSAPLIDKYVSDLELLQLL

SEQ ID NO: 92 - DNA, 669 bp, Artificial Sequence
  Description of Artificial Sequence: Synthetic polynucleotide
atgattgaaaccattctgcctgcaggcgttgaaagcgcagaactgctggaatatccggaagatctgaaagcacatccggcagaagaacatctgattgccaaaagcgttgaaaaacgtcgtcgtgattttattggtgcacgtcattgtgcacgtctggcactggcagaactgggtgaacctccggttgcaattggtaaaggtgaacgtggtgcaccgatttggcctcgtggtgttgttggtagcctgacccattgtgatggttatcgtgcagcagcagttgcacataaaatgcgctttcgcagcattggtattgatgcagaaccgcatgcaaccctgccggaaggtgttctggatagcgttagcctgccgccggaacgtgaatggctgaaaaccaccgatagcgcactgcatctggatcgtctgctgttttgtgcaaaagaagccacctataaagcctggtggccgctgacagcacgttggctgggttttgaagaagcccatattacctttgaaattgaagatggtagcgcagatagcggtaatggcacctttcatagcgaactgctggttccgggtcagaccaatgatggtggtacaccgctgctgagctttgatggtcgttggctgattgcagatggttttattctgaccgcaattgcctatgcctaa

SEQ ID NO: 93 - protein, 222 aa, Artificial Sequence
  Description of Artificial Sequence: Synthetic polypeptide
MIETILPAGVESAELLEYPEDLKAHPAEEHLIAKSVEKRRRDFIGARHCARLALAELGEPPVAIGKGERGAPIWPRGVVGSLTHCDGYRAAAVAHKMRFRSIGIDAEPHATLPEGVLDSVSLPPEREWLKTTDSALHLDRLLFCAKEATYKAWWPLTARWLGFEEAHITFEIEDGSADSGNGTFHSELLVPGQTNDGGTPLLSFDGRWLIADGFILTAIAYA

SEQ ID NO: 94 - DNA, 3522 bp, Mycobacterium smegmatis
atgaccagcgatgttcacgacgccacagacggcgtcaccgaaaccgcactcgacgacgagcagtcgacccgccgcatcgccgagctgtacgccaccgatcccgagttcgccgccgccgcaccgttgcccgccgtggtcgacgcggcgcacaaacccgggctgcggctggcagagatcctgcagaccctgttcaccggctacggtgaccgcccggcgctgggataccgcgcccgtgaactggccaccgacgagggcgggcgcaccgtgacgcgtctgctgccgcggttcgacaccctcacctacgcccaggtgtggtcgcgcgtgcaagcggtcgccgcggccctgcgccacaacttcgcgcagccgatctaccccggcgacgccgtcgcgacgatcggtttcgcgagtcccgattacctgacgctggatctcgtatgcgcctacctgggcctcgtgagtgttccgctgcagcacaacgcaccggtcagccggctcgccccgatcctggccgaggtcgaaccgcggatcctcaccgtgagcgccgaatacctcgacctcgcagtcgaatccgtgcgggacgtcaactcggtgtcgcagctcgtggtgttcgaccatcaccccgaggtcgacgaccaccgcgacgcactggcccgcgcgcgtgaacaactcgccggcaagggcatcgccgtcaccaccctggacgcgatcgccgacgagggcgccgggctgccggccgaaccgatctacaccgccgaccatgatcagcgcctcgcgatgatcctgtacacctcgggttccaccggcgcacccaagggtgcgatgtacaccgaggcgatggtggcgcggctgtggaccatgtcgttcatcacgggtgaccccacgccggtcatcaacgtcaacttcatgccgctcaaccacctgggcgggcgcatccccatttccaccgccgtgcagaacggtggaaccagttacttcgtaccggaatccgacatgtccacgctgttcgaggatctcgcgctggtgcgcccgaccgaactcggcctggttccgcgcgtcgccgacatgctctaccagcaccacctcgccaccgtcgaccgcctggtcacgcagggcgccgacgaactgaccgccgagaagcaggccggtgccgaactgcgtgagcaggtgctcggcggacgcgtgatcaccggattcgtcagcaccgcaccgctggccgcggagatgagggcgttcctcgacatcaccctgggcgcacacatcgtcgacggctacgggctcaccgagaccggcgccgtgacacgcgacggtgtgatcgtgcggccaccggtgatcgactacaagctgatcgacgttcccgaactcggctacttcagcaccgacaagccctacccgcgtggcgaactgctggtcaggtcgcaaacgctgactcccgggtactacaagcgccccgaggtcaccgcgagcgtcttcgaccgggacggctactaccacaccggcgacgtcatggccgagaccgcacccgaccacctggtgtacgtggaccgtcgcaacaacgtcctcaaactcgcgcagggcgagttcgtggcggtcgccaacctggaggcggtgttctccggcgcggcgctggtgcgccagatcttcgtgtacggcaacagcgagcgcagtttccttctggccgtggtggtcccgacgccggaggcgctcgagcagtacgatccggccgcgctcaaggccgcgctggccgactcgctgcagcgcaccgcacgcgacgccgaactgcaatcctacgaggtgccggccgatttcatcgtcgagaccgagccgttcagcgccgccaacgggctgctgtcgggtgtcggaaaactgctgcggcccaacctcaaagaccgctacgggcagcgcctggagcagatgtacgccgatatcgcggccacgcaggccaaccagttgcgcgaactgcggcgcgcggccgccacacaaccggtgatcgacaccctcacccaggccgctgccacgatcctcggcaccgggagcgaggtggcatccgacgcccacttcaccgacctgggcggggattccctgtcggcgctgacactttcgaacctgctgagcgatttcttcggtttcgaagttcccgtcggcaccatcgtgaacccggccaccaacctcgcccaactcgcccagcacatcgaggcgcagcgcaccgcgggtgaccgcaggccgagtttcaccaccgtgcacggcgcggacgccaccgagatccgggcgagtgagctgaccctggacaagttcatcgacgccgaaacgctccgggccgcaccgggtctgcccaaggtcaccaccgagccacggacggtgttgctctcgggcgccaacggctggctgggccggttcctcacgttgcagtggctggaacgcctggcacctgtcggcggcaccctcatcacgatcgtgcggggccgcgacgacgccgcggcccgcgcacggctgacccaggcctacgacaccgatcccgagttgtcccgccgcttcgccgagctggccgaccgccacctgcgggtggtcgccggtgacatcggcgacccgaatctgggcctcacacccgagatctggcaccggctcgccgccgaggtcgacctggtggtgcatccggcagcgctggtcaaccacgtgctcccctaccggcagctgttcggccccaacgtcgtgggcacggccgaggtgatcaagctggccctcaccgaacggatcaagcccgtcacgtacctgtccaccgtgtcggtggccatggggatccccgacttcgaggaggacggcgacatccggaccgtgagcccggtgcgcccgctcgacggcggatacgccaacggctacggcaacagcaagtgggccggcgaggtgctgctgcgggaggcccacgatctgtgcgggctgcccgtggcgacgttccgctcggacatgatcctggcgcatccgcgctaccgcggtcaggtcaacgtgccagacatgttcacgcgactcctgttgagcctcttgatcaccggcgtcgcgccgcggtcgttctacatcggagacggtgagcgcccgcgggcgcactaccccggcctgacggtcgatttcgtggccgaggcggtcacgacgctcggcgcgcagcagcgcgagggatacgtgtcctacgacgtgatgaacccgcacgacgacgggatctccctggatgtgttcgtggactggctgatccgggcgggccatccgatcgaccgggtcgacgactacgacgactgggtgcgtcggttcgagaccgcgttgaccgcgcttcccgagaagcgccgcgcacagaccgtactgccgctgctgcacgcgttccgcgctccgcaggcaccgttgcgcggcgcacccgaacccacggaggtgttccacgccgcggtgcgcaccgcgaaggtgggcccgggagacatcccgcacctcgacgaggcgctgatcgacaagtacatacgcgatctgcgtgagttcggtctgatctaa

SEQ ID NO: 95 - protein, 1173 aa, Mycobacterium smegmatis
MTSDVHDATDGVTETALDDEQSTRRIAELYATDPEFAAAAPLPAVVDAAHKPGLRLAEILQTLFTGYGDRPALGYRARELATDEGGRTVTRLLPRFDTLTYAQVWSRVQAVAAALRHNFAQPIYPGDAVATIGFASPDYLTLDLVCAYLGLVSVPLQHNAPVSRLAPILAEVEPRILTVSAEYLDLAVESVRDVNSVSQLVVFDHHPEVDDHRDALARAREQLAGKGIAVTTLDAIADEGAGLPAEPIYTADHDQRLAMILYTSGSTGAPKGAMYTEAMVARLWTMSFITGDPTPVINVNFMPLNHLGGRIPISTAVQNGGTSYFVPESDMSTLFEDLALVRPTELGLVPRVADMLYQHHLATVDRLVTQGADELTAEKQAGAELREQVLGGRVITGFVSTAPLAAEMRAFLDITLGAHIVDGYGLTETGAVTRDGVIVRPPVIDYKLIDVPELGYFSTDKPYPRGELLVRSQTLTPGYYKRPEVTASVFDRDGYYHTGDVMAETAPDHLVYVDRRNNVLKLAQGEFVAVANLEAVFSGAALVRQIFVYGNSERSFLLAVVVPTPEALEQYDPAALKAALADSLQRTARDAELQSYEVPADFIVETEPFSAANGLLSGVGKLLRPNLKDRYGQRLEQMYADIAATQANQLRELRRAAATQPVIDTLTQAAATILGTGSEVASDAHFTDLGGDSLSALTLSNLLSDFFGFEVPVGTIVNPATNLAQLAQHIEAQRTAGDRRPSFTTVHGADATEIRASELTLDKFIDAETLRAAPGLPKVTTEPRTVLLSGANGWLGRFLTLQWLERLAPVGGTLITIVRGRDDAAARARLTQAYDTDPELSRRFAELADRHLRVVAGDIGDPNLGLTPEIWHRLAAEVDLVVHPAALVNHVLPYRQLFGPNVVGTAEVIKLALTERIKPVTYLSTVSVAMGIPDFEEDGDIRTVSPVRPLDGGYANGYGNSKWAGEVLLREAHDLCGLPVATFRSDMILAHPRYRGQVNVPDMFTRLLLSLLITGVAPRSFYIGDGERPRAHYPGLTVDFVAEAVTTLGAQQREGYVSYDVMNPHDDGISLDVFVDWLIRAGHPIDRVDDYDDWVRRFETALTALPEKRRAQTVLPLLHAFRAPQAPLRGAPEPTEVFHAAVRTAKVGPGDIPHLDEALIDKYIRDLREFGLI

SEQ ID NO: 96 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacagcgaagtagcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccacagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgcttgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtaggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaaactgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctatggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcgtcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctaa

SEQ ID NO: 97 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 98 - DNA, 3525 bp, Mycobacterium marinum
atgtcgccaatcacgcgtgaagagcggctcgagcgccgcatccaggacctctacgccaacgacccgcagttcgccgccgccaaacccgccacggcgatcaccgcagcaatcgagcggccgggtctaccgctaccccagatcatcgagaccgtcatgaccggatacgccgatcggccggctctcgctcagcgctcggtcgaattcgtgaccgacgccggcaccggccacaccacgctgcgactgctcccccacttcgaaaccatcagctacggcgagctttgggaccgcatcagcgcactggccgacgtgctcagcaccgaacagacggtgaaaccgggcgaccgggtctgcttgttgggcttcaacagcgtcgactacgccacgatcgacatgactttggcgcggctgggcgcggtggccgtaccactgcagaccagcgcggcgataacccagctgcagccgatcgtcgccgagacccagcccaccatgatcgcggccagcgtcgacgcactcgctgacgccaccgaattggctctgtccggtcagaccgctacccgagtcctggtgttcgaccaccaccggcaggttgacgcacaccgcgcagcggtcgaatccgcccgggagcgcctggccggctcggcggtcgtcgaaaccctggccgaggccatcgcgcgcggcgacgtgccccgcggtgcgtccgccggctcggcgcccggcaccgatgtgtccgacgactcgctcgcgctactgatctacacctcgggcagcacgggtgcgcccaagggcgcgatgtacccccgacgcaacgttgcgaccttctggcgcaagcgcacctggttcgaaggcggctacgagccgtcgatcacgctgaacttcatgccaatgagccacgtcatgggccgccaaatcctgtacggcacgctgtgcaatggcggcaccgcctacttcgtggcgaaaagcgatctctccaccttgttcgaagacctggcgctggtgcggcccaccgagctgaccttcgtgccgcgcgtgtgggacatggtgttcgacgagtttcagagtgaggtcgaccgccgcctggtcgacggcgccgaccgggtcgcgctcgaagcccaggtcaaggccgagatacgcaacgacgtgctcggtggacggtataccagcgcactgaccggctccgcccctatctccgacgagatgaaggcgtgggtcgaggagctgctcgacatgcatctggtcgagggctacggctccaccgaggccgggatgatcctgatcgacggagccattcggcgcccggcggtactcgactacaagctggtcgatgttcccgacctgggttacttcctgaccgaccggccacatccgcggggcgagttgctggtcaagaccgatagtttgttcccgggctactaccagcgagccgaagtcaccgccgacgtgttcgatgctgacggcttctaccggaccggcgacatcatggccgaggtcggccccgaacagttcgtgtacctcgaccgccgcaacaacgtgttgaagctgtcgcagggcgagttcgtcaccgtctccaaactcgaagcggtgtttggcgacagcccactggtacggcagatctacatctacggcaacagcgcccgtgcctacctgttggcggtgatcgtccccacccaggaggcgctggacgccgtgcctgtcgaggagctcaaggcgcggctgggcgactcgctgcaagaggtcgcaaaggccgccggcctgcagtcctacgagatcccgcgcgacttcatcatcgaaacaacaccatggacgctggagaacggcctgctcaccggcatccgcaagttggccaggccgcagctgaaaaagcattacggcgagcttctcgagcagatctacacggacctggcacacggccaggccgacgaactgcgctcgctgcgccaaagcggtgccgatgcgccggtgctggtgacggtgtgccgtgcggcggccgcgctgttgggcggcagcgcctctgacgtccagcccgatgcgcacttcaccgatttgggcggcgactcgctgtcggcgctgtcgttcaccaacctgctgcacgagatcttcgacatcgaagtgccggtgggcgtcatcgtcagccccgccaacgacttgcaggccctggccgactacgtcgaggcggctcgcaaacccggctcgtcacggccgaccttcgcctcggtccacggcgcctcgaatgggcaggtcaccgaggtgcatgccggtgacctgtccctggacaaattcatcgatgccgcaaccctggccgaagctccccggctgcccgccgcaaacacccaagtgcgcaccgtgctgctgaccggcgccaccggcttcctcgggcgctacctggccctggaatggctggagcggatggacctggtcgacggcaaactgatctgcctggtccgggccaagtccgacaccgaagcacgggcgcggctggacaagacgttcgacagcggcgaccccgaactgctggcccactaccgcgcactggccggcgaccacctcgaggtgctcgccggtgacaagggcgaagccgacctcggactggaccggcagacctggcaacgcctggccgacacggtcgacctgatcgtcgaccccgcggccctggtcaaccacgtactgccatacagccagctgttcgggcccaacgcgctgggcaccgccgagctgctgcggctggcgctcacctccaagatcaagccctacagctacacctcgacaatcggtgtcgccgaccagatcccgccgtcggcgttcaccgaggacgccgacatccgggtcatcagcgccacccgcgcggtcgacgacagctacgccaatggctactcgaacagcaagtgggccggcgaggtgctgttgcgcgaggcgcatgacctgtgtggcctgccggttgcggtgttccgctgcgacatgatcctggccgacaccacatgggcgggacagctcaatgtgccggacatgttcacccggatgatcctgagcctggcggccaccggtatcgcgccgggttcgttctatgagcttgcggccgacggcgcccggcaacgcgcccactatgacggtctgcccgtcgagttcatcgccgaggcgatttcgactttgggtgcgcagagccaggatggtttccacacgtatcacgtgatgaacccctacgacgacggcatcggactcgacgagttcgtcgactggctcaacgagtccggttgccccatccagcgcatcgctgactatggcgactggctgcagcgcttcgaaaccgcactgcgcgcactgcccgatcggcagcggcacagctcactgctgccgctgttgcacaactatcggcagccggagcggcccgtccgcgggtcgatcgcccctaccgatcgcttccgggcagcggtgcaagaggccaagatcggccccgacaaagacattccgcacgtcggcgcgccgatcatcgtgaagtacgtcagcgacctgcgcctactcggcctgctctaa

SEQ ID NO: 99 - protein, 1174 aa, Mycobacterium marinum
MSPITREERLERRIQDLYANDPQFAAAKPATAITAAIERPGLPLPQIIETVMTGYADRPALAQRSVEFVTDAGTGHTTLRLLPHFETISYGELWDRISALADVLSTEQTVKPGDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVAKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLENGLLTGIRKLARPQLKKHYGELLEQIYTDLAHGQADELRSLRQSGADAPVLVTVCRAAAALLGGSASDVQPDAHFTDLGGDSLSALSFTNLLHEIFDIEVPVGVIVSPANDLQALADYVEAARKPGSSRPTFASVHGASNGQVTEVHAGDLSLDKFIDAATLAEAPRLPAANTQVRTVLLTGATGFLGRYLALEWLERMDLVDGKLICLVRAKSDTEARARLDKTFDSGDPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHDLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 100 - DNA, 40 bp, Artificial Sequence
  Description of Artificial Sequence: Synthetic primer
gaggagaagtcgacatgaacgaacaatattccgcattgcg

SEQ ID NO: 101 - DNA, 39 bp, Artificial Sequence
  Description of Artificial Sequence: Synthetic primer
ggaagctttctagattagccggtattacgcatacctgcc

SEQ ID NO: 102 - DNA, 47 bp, Artificial Sequence
  Description of Artificial Sequence: Synthetic primer
taagctagcaagaggagaagtcgacatgcagaacagcgctttgaaag

SEQ ID NO: 103 - DNA, 43 bp, Artificial Sequence
  Description of Artificial Sequence: Synthetic primer
gcctctaggaagctttctagattactttttcttcgctttggcg

SEQ ID NO: 104 - DNA, 49 bp, Artificial Sequence
  Description of Artificial Sequence: Synthetic primer
ctagcaagaggagaagtcgacatgcctgacgctaaaaaacaggggcggt

SEQ ID NO: 105 - DNA, 48 bp, Artificial Sequence
  Description of Artificial Sequence: Synthetic primer
ctaggaagctttctagagtcgttaatcgtgagcgcctatttcgcgcag

SEQ ID NO: 106 - DNA, 51 bp, Artificial Sequence
  Description of Artificial Sequence: Synthetic primer
ctagcaagaggagaagtcgacatgacaaagtatgcattagtcggtgatgtg

SEQ ID NO: 107 - DNA, 54 bp, Artificial Sequence
  Description of Artificial Sequence: Synthetic primer
ctaggaagctttctagagtcgttacagaatgtgacctaaggtctggcgtaaatg

SEQ ID NO: 108 - DNA, 51 bp, Artificial Sequence
  Description of Artificial Sequence: Synthetic primer
ctagcaagaggagaagtcgacatgagttctgaaagtagtcagggtctagtc

SEQ ID NO: 109 - DNA, 45 bp, Artificial Sequence
  Description of Artificial Sequence: Synthetic primer
ctaggaagctttctagagtcgttacttctgggagcgccacatctc

SEQ ID NO: 110 - DNA, 45 bp, Artificial Sequence
  Description of Artificial Sequence: Synthetic primer
tagcaagaggagaagtcgacatggactggaagaagatctatgaag

SEQ ID NO: 111 - DNA, 39 bp, Artificial Sequence
  Description of Artificial Sequence: Synthetic primer
cctctaggaagctttctagattagaatgccgcgttgaag

SEQ ID NO: 112 - DNA, 42 bp, Artificial Sequence
  Description of Artificial Sequence: Synthetic primer
tagcaagaggagaagtcgacatgagctggcaagaactgtatc

SEQ ID NO: 113 - DNA, 47 bp, Artificial Sequence
  Description of Artificial Sequence: Synthetic primer
cctctaggaagctttctagattaatatttctctttaaagcgcttttc

SEQ ID NO: 114 - DNA, 43 bp, Artificial Sequence
  Description of Artificial Sequence: Synthetic primer
tagcaagaggagaagtcgacatggcacgttttactttaccaag

SEQ ID NO: 115 - DNA, 52 bp, Artificial Sequence
  Description of Artificial Sequence: Synthetic primer
cctctaggaagctttctagattacaaattaactttagttccatagtatgtgc

SEQ ID NO: 116 - DNA, 100 bp, Artificial Sequence
  Description of Artificial Sequence: Synthetic primer
accggtaaacgactcagcagcctgacgcactggcgatattattttgccttctcctcaccacagaatgttctgccacctgacgatatcaaattacgccccg

SEQ ID NO: 117 - DNA, 104 bp, Artificial Sequence
  Description of Artificial Sequence: Synthetic primer
tgcttatccacaacattttgcgcacggttatgtggacaaaatacctggttacccaggccgtgccggcacgttaaccgggccctaggtctagggcggcggatttg

SEQ ID NO: 118 - DNA, 20 bp, Artificial Sequence
  Description of Artificial Sequence: Synthetic primer
aggcagttccataggatggc

SEQ ID NO: 119 - DNA, 40 bp, Artificial Sequence
  Description of Artificial Sequence: Synthetic primer
ataataataggtaccggcggcgctggcgcagcttgctgcg

SEQ ID NO: 120 - DNA, 41 bp, Artificial Sequence
  Description of Artificial Sequence: Synthetic primer
tattattatggatccaacccgataatggtagatctccctct

SEQ ID NO: 121 - DNA, 41 bp, Artificial Sequence
  Description of Artificial Sequence: Synthetic primer
ataataataggatccggagcagaaacaatgtggtatttact

SEQ ID NO: 122 - DNA, 43 bp, Artificial Sequence
  Description of Artificial Sequence: Synthetic primer
tattattatctgcagatgctcttttttatgcattacaaactgc

SEQ ID NO: 123 - DNA, 35 bp, Artificial Sequence
  Description of Artificial Sequence: Synthetic primer
taataataaggtaccaactgggcttgcttcactgg

SEQ ID NO: 124 - DNA, 35 bp, Artificial Sequence
  Description of Artificial Sequence: Synthetic primer
taataataaagatctgcctcgaccgttcaggaagg

SEQ ID NO: 125 - DNA, 38 bp, Artificial Sequence
  Description of Artificial Sequence: Synthetic primer
taataataaagatcttaactctccagtaacaaagctgc

SEQ ID NO: 126 - DNA, 34 bp, Artificial Sequence
  Description of Artificial Sequence: Synthetic primer
taataataactgcaggctatgtcaccacttacgg

SEQ ID NO: 127 - DNA, 37 bp, Artificial Sequence
  Description of Artificial Sequence: Synthetic primer
tattattattcctgcaggcgtctttgttcttccgtcc

SEQ ID NO: 128 - DNA, 38 bp, Artificial Sequence
  Description of Artificial Sequence: Synthetic primer
tattattatcttcggtacctttagcatctgcttcggcc

SEQ ID NO: 129 - DNA, 39 bp, Artificial Sequence
  Description of Artificial Sequence: Synthetic primer
tattattatggatcccggtaatgcaacaaaagttagagc

SEQ ID NO: 130 - DNA, 48 bp, Artificial Sequence
  Description of Artificial Sequence: Synthetic primer
tattattatggatccaaagtgactgacatgaatatccttgatttgttc

SEQ ID NO: 131 - DNA, 39 bp, Artificial Sequence
  Description of Artificial Sequence: Synthetic primer
taataataaggatcctacactggcggatgtggcataaac

SEQ ID NO: 132 - DNA, 39 bp, Artificial Sequence
  Description of Artificial Sequence: Synthetic primer
taataatttggtacccattcacagtcaccaggtacaacg

SEQ ID NO: 133 - DNA, 39 bp, Artificial Sequence
  Description of Artificial Sequence: Synthetic primer
taataataaggatccgagaataacatgaatggtgcattg

SEQ ID NO: 134 - DNA, 39 bp, Artificial Sequence
  Description of Artificial Sequence: Synthetic primer
taataatatctgcagatccacaaaaagccctggcaattg

SEQ ID NO: 135 - DNA, 31 bp, Artificial Sequence
  Description of Artificial Sequence: Synthetic primer
gataatcccccctgcagggagcggtaaatag

SEQ ID NO: 136 - DNA, 34 bp, Artificial Sequence
  Description of Artificial Sequence: Synthetic primer
tattattttggatccttctctggtgttgtttggg

SEQ ID NO: 137 - DNA, 33 bp, Artificial Sequence
  Description of Artificial Sequence: Synthetic primer
tattattatggatccgcgtggtgttgaaagccg

SEQ ID NO: 138 - DNA, 38 bp, Artificial Sequence
  Description of Artificial Sequence: Synthetic primer
tattataaaggtaccgcctcttccaggtcagtgaaggg

SEQ ID NO: 139 - DNA, 36 bp, Artificial Sequence
  Description of Artificial Sequence: Synthetic primer
taataataaggtacccagttttggctatgccttaag

SEQ ID NO: 140 - DNA, 34 bp, Artificial Sequence
  Description of Artificial Sequence: Synthetic primer
taataatcattaagcttgctccctttgctgggcc

SEQ ID NO: 141 - DNA, 35 bp, Artificial Sequence
  Description of Artificial Sequence: Synthetic primer
taataataataagctttttacgcctcaaactttcg

SEQ ID NO: 142 - DNA, 41 bp, Artificial Sequence
  Description of Artificial Sequence: Synthetic primer
taataataaattgccctgcagcgtaagattgtcgttcaggg

SEQ ID NO: 143 - DNA, 31 bp, Artificial Sequence
  Description of Artificial Sequence: Synthetic primer
tattattattgtttggtacctctgtgccgct

SEQ ID NO: 144 - DNA, 33 bp, Artificial Sequence
  Description of Artificial Sequence: Synthetic primer
aatgttccactctgcagggatgataataagggg

SEQ ID NO: 145 - DNA, 29 bp, Artificial Sequence
  Description of Artificial Sequence: Synthetic primer
atcggatccaatcgcacactaacagactg

SEQ ID NO: 146 - DNA, 38 bp, Artificial Sequence
  Description of Artificial Sequence: Synthetic primer
acagctttggatcctcattgtgtttactcctgattagc

SEQ ID NO: 147 - DNA, 42 bp, Artificial Sequence
  Description of Artificial Sequence: Synthetic primer
ataataatatctagagcagcaagccgcgcggcaggtggtcag

SEQ ID NO: 148 - DNA, 42 bp, Artificial Sequence
  Description of Artificial Sequence: Synthetic primer
tattattatctgcagacgccatcctgatccatatgtatatgg

SEQ ID NO: 149 - DNA, 42 bp, Artificial Sequence
  Description of Artificial Sequence: Synthetic primer
tattattatggatccagttcctccttttcggatgatgttctg

SEQ ID NO: 150 - DNA, 42 bp, Artificial Sequence
  Description of Artificial Sequence: Synthetic primer
ataataataggatccgaggcctttgctgcgactgccatgttc

SEQ ID NO: 151 - DNA, 20 bp, Artificial Sequence
  Description of Artificial Sequence: Synthetic primer
cgccacaaccagtgacaccc

SEQ ID NO: 152 - DNA, 24 bp, Artificial Sequence
  Description of Artificial Sequence: Synthetic primer
ggggttttagtcgccctttctggc

SEQ ID NO: 153 - DNA, 24 bp, Artificial Sequence
  Description of Artificial Sequence: Synthetic primer
cgggatctggtggcgtttaaagtg

SEQ ID NO: 154 - DNA, 21 bp, Artificial Sequence
  Description of Artificial Sequence: Synthetic primer
tgacggcgtttgtcttcaccg

SEQ ID NO: 155 - DNA, 53 bp, Artificial Sequence
  Description of Artificial Sequence: Synthetic primer
acgctatggaactgcaggatgagagcatgaaatggaacggatgcgcgccttat

SEQ ID NO: 156 - DNA, 53 bp, Artificial Sequence
  Description of Artificial Sequence: Synthetic primer
acgctatggaactgcaggatgagagcatctgccccagatcgttggctttttgc

SEQ ID NO: 157 - DNA, 40 bp, Artificial Sequence
  Description of Artificial Sequence: Synthetic primer
tttgaaaacaggatgtagcgatgaccgatattcgcttgta

SEQ ID NO: 158 - DNA, 40 bp, Artificial Sequence
  Description of Artificial Sequence: Synthetic primer
tacaagcgaatatcggtcatcgctacatcctgttttcaaa

SEQ ID NO: 159 - DNA, 40 bp, Artificial Sequence
  Description of Artificial Sequence: Synthetic primer
cgcctgaatactacgattgactggagaatgcgaatgaaca

SEQ ID NO: 160 - DNA, 40 bp, Artificial Sequence
  Description of Artificial Sequence: Synthetic primer
tgttcattcgcattctccagtcaatcgtagtattcaggcg

SEQ ID NO: 161 - DNA, 39 bp, Artificial Sequence
  Description of Artificial Sequence: Synthetic primer
tttgaaaacaggatgtagcggcccgtagtctgcaaatcc

SEQ ID NO: 162 - DNA, 39 bp, Artificial Sequence
  Description of Artificial Sequence: Synthetic primer
ggatttgcagactacgggccgctacatcctgttttcaaa

SEQ ID NO: 163 - DNA, 40 bp, Artificial Sequence
  Description of Artificial Sequence: Synthetic primer
gcattacgctgacttgacggctggagaatgcgaatgaaca

SEQ ID NO: 164 - DNA, 40 bp, Artificial Sequence
  Description of Artificial Sequence: Synthetic primer
tgttcattcgcattctccagccgtcaagtcagcgtaatgc

SEQ ID NO: 165 - DNA, 200 bp, Artificial Sequence
  Description of Artificial Sequence: Synthetic polynucleotide
actggagaatgcgaatgaacagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaggtg

SEQ ID NO: 166 - DNA, 21 bp, Artificial Sequence
  Description of Artificial Sequence: Synthetic oligonucleotide
ggcgaaagagtctgctccggc

SEQ ID NO: 167 - DNA, 23 bp, Artificial Sequence
  Description of Artificial Sequence: Synthetic oligonucleotide
cattcagacacaacgcatcgcgg

SEQ ID NO: 168 - DNA, 43 bp, Artificial Sequence
  Description of Artificial Sequence: Synthetic oligonucleotide
ggcttaccagcaccggtgggttatgcccgtagtctgcaaatcc

SEQ ID NO: 169 - DNA, 42 bp, Artificial Sequence
  Description of Artificial Sequence: Synthetic oligonucleotide
gcattacgctgacttgacgggtgaaaaccgttcgcagcctgg

SEQ ID NO: 170 - DNA, 43 bp, Artificial Sequence; identical to SEQ ID NO: 168
  Description of Artificial Sequence: Synthetic oligonucleotide

SEQ ID NO: 171 - DNA, 42 bp, Artificial Sequence
  Description of Artificial Sequence: Synthetic oligonucleotide
ccaggctgcgaacggttttcacccgtcaagtcagcgtaatgc

SEQ ID NO: 172 - DNA, 46 bp, Artificial Sequence
  Description of Artificial Sequence: Synthetic oligonucleotide
ggcttaccagcaccggtgggttatgtgaaaaccgttcgcagcctgg

SEQ ID NO: 173 - DNA, 46 bp, Artificial Sequence
  Description of Artificial Sequence: Synthetic oligonucleotide
ccaggctgcgaacggttttcacataacccaccggtgctggtaagcc

SEQ ID NO: 174 - DNA, 1317 bp, Artificial Sequence
  Description of Artificial Sequence: Synthetic polynucleotide
atggactggaagaagatctatgaagacagaacctgcactgcagatgaagcagtaaagagcattaagtcaggtgaccgcgtgctgtttgcgcactgtgttgctgaaccgccagttctggtagaagcaatggttgcgaatgcagctgcatacaagaatgtcacggtttcacacatggttacccttggtaagggtgaatactcaaaaccagaatataaagaaaactttacttttgaaggttggtttaccagcccttcaacacgtggatccattgcagaaggacacggacagtttgtccctgtattcttccacgaggtaccatctttaatccgtaaagacattttccatgttgatgtattcatggtaatggtatccccgccagatcataacggtttctgctgtgtgggtgtatcttctgactataccatgcaggctatcaaatcagcaaaaattgtactggctgaagtgaatgatcaggtacctgtagtttatggcgatacctttgttcacgttagtgaaatcgacaagttcgttgaaacttcacatccactgccagaaatcggtctgccgaagatcggtgaagtagaagctgctattggtaagcactgcgcttcgctgatcgaagatggttccacattacagcttggtatcggcgctattccggatgctgtactttcacagcttaaggacaagaaacaccttggtatccactctgaaatgatttccgacggtgttgttgatctttacgaagcaggcgttattgactgcagccaaaagtctatcgacaaaggcaaaatggcaataacattcttaatgggaacgaagcgtctttatgatttcgctgcaaacaatccaaaggttgaattaaagccggttgactacatcaatcatccatctgtagttgcacagtgcagcaaaatggtttgcatcaatgcttgcttgcaagttgattttatgggtcagattgtctccgatagtattggcacaaagcagttctccggcgtaggcggtcaggttgacttcgtacgcggtgcatccatgtctattgacggcaaaggtaaagcgatcatcgcgatgccttccgttgcaaagaagaaagatggcagtatgatttcgaagatcgttccattcatcgatcacggtgcagctgtaactacatcccgtaacgatgcggactatgtcgtaacggaatatggtattgctgaaatgaagggtaagtcgttacaggaccgcgcacgcgcgttaatcaatattgcccaccctgatttcaaagatgaattaaaggctgaatttgaaaagcgcttcaacgcggcattctaa

SEQ ID NO: 175 - DNA, 1308 bp, Artificial Sequence
  Description of Artificial Sequence: Synthetic polynucleotide
atgagctggcaagaactgtatcaaagtaaattatgttcagccacagaagcggtaaaacagattaaaaacggtgataccgtggtatttgcccattgtgtaggtgaaccgcctgcactggtggaggcgatgattgaaaatgctgaacaatataaagatgttgagattaaacatatggttagcctgggtagtggtggttatactgcgaaagggatggaagcgcattttcgcgtaaatccaatgtttgtcagcggcaatgtacgtaaggcgattgaaaatggcgatggtgattttacacctgcattcttccatgaagtaccaaagttgctgcgtgaaaaacgtctgaaatgtgatgttgttctggcacaggtaacgccaccagatgaacatggttattgttcgctgggaacaagcgttgattatacctatgaagccattaaaaccgcgcgcaccgtaattgttcaggtgaatgaccagtttcctcgcacctatggtgaggtggtgcatgtcagcgagtttgactatatcgttgaaaaatcacaaccgctgtttgaactgcaacctgcaaagattggcgaagttgaagaagcgattggtaaaaattgtgcctcgctgattgaagatggtagcacgttacagctggggattggtgggattccggatgcggtgatgttatttctgactgataaaaaagatttagggattcatagcgaaatgattagcgatggcacgctggcgctttatgaaaaaggtgttattaatggtaaatataaaaattttgataaagaaaaaatgacggttaccttcctgatgggtactaaaaaactgtatgactttgccaataataacccggcagtagaggtaaaaccggtagactatgtgaatcatccggcaattatcatgaaacaacataagatggtttctattaatagcgccattcaggttgatttaatggggcaggtggttgcagaggcgatgggactgcgccaattttccggtgttggcggtcaggttgactttattcgtggcgtgtcgatgggtgaagatggcaaggcgattatcgcgatgccttcaatcactacaaaaaaagatggtacggtaattagcaaaatcgtctctattgtcgatgaaggtgcaccgattaccacctcacgtaatgatgttgattatattgtcacagaatacggtattgcagaattaaaaggcaaatcgctgcgtgaacgcgcacgtaatctgattaatattgctcatccatcggtacgtgaatcgctggcagtagaatttgaaaagcgctttaaagagaaatattaa

SEQ ID NO: 176 - DNA, 1539 bp, Artificial Sequence
  Description of Artificial Sequence: Synthetic polynucleotide
atggatttgaagctgaccgatgcggacgttgaggcaatcgtagcgcaagtcatggctaacattgagcgccgtctgggtagcgcggaagcgggcagcgcagcatccgctgcgtcgccggcaccggctgcgccggttcgtaccgctccgggtggcagcccggcagccagcccgcgtccggagtacggtgtttttgatcgtgcggaggatgcagtcgccgctgccgccgaagctcaggaagccttcctgcgccagtgtcgtctgcaagaccgtgagcgcattctgcgtgccatccgtgaagagactctggcacgcaaggaagaattggcacgcctgatttgggaggaaacgaagctgggtcgcttggaacacaaaattgcaaagctggaattgacggcgctgaaaaccccgggtacggaggatctgcgcaccgaggcatttagcggcgacaacggcctgaccatcgtcgaacatgcgccgtacggtgtgattggcgcggttaccccggttacgaaccctgcggagactattatcaacaacgcgatcggcatgctggcaagcggtaatgcagtggtgttcaacgtgcaccctagcgctaaacgttgctccgcgtataccgtccagatgatcaataaagcagtgatggcagcgggtggtccgccgaatctggttacgatggttcgcgagccgaccatggaaaccctgaatgcgatcatccgcagcccgagcgtgaagctgctggtgggcaccggcggtccgggtctggttagcaccctgctgcgctctggtaagaaagcgattggtgcgggtgcgggcaatccgccggtcgttgtggatgataccgccgacctggagcatgcggcaaaggaaatcatcaaaggcgcgtcctttgacaacaatattctgtgtattgcggagaaagaggtttttgtggttgataaagcggccgacggtctgatctatcacatgctggataacggcgcatacatgctgggtcgtgacgagctggagaaggtgatgcaattcgcgctgaccgcggacgaaagccagggcggtgcgggttgctctattgatccgcgtcgtgcgtggcatgtgactaaggagtgggtgggcaaagatgcgcgcttgttcctggagaagattggtgtcaagactgaccgtccggttgacttgctgttgtgcgaggttgactttgaccacccgttcgtgcagctggaacaaatgatgccagtactgccgattgttcgtgtccgtgacctggatgaagccatcggtatggccgtccgtgcggagcacggcaatcgtcacaccgcaattatgcatagccgtaacgtggacaatctgacccgttttgcccgtgccattgccacgaccatcttcgtcaaaaacgcaagcagcttggcgggtgttggttatggcggtgaaggttttaccaccatgacgatcgccggtccaacgggcgagggtctgacgtcggctcgtacgttcacgcgcaaagtccgctgtgtcctggcggacggcggtttccgtatcgttggttaa

SEQ ID NO: 177 - DNA, 792 bp, Yersinia intermedia
atgaccgatattcgcttgtatatgtttcaaactggctcgctgaagtgcaaagtccacaatatcaaaatgaatcaaggaggtggagcggattatgaaatccctgtcccgttcttcctgctgacccatcctgatggtcacacgctgattgatggcgggaatgctgtcgaaaccgccactgatcccaaagggtattggggcgggattaccgaggtttattggccggtaatgcgtgaagatgagggctgtgtagcgcagcttaaaaaaatggggatcaatcccgaagatatccggtatgtcttgcagtcgcacttgcatcttgatcataccggtgcgattggccgattccccaatgcgacacacatcgttcagcgccgtgagtacgagtatgcctttactcctgactggtttgctgcgggaggctatatcagaaacgactttgaccggccgggtctgaaatgggcgtttctggaaggcgaaaacaatgatttttatgatatctatggcgacggtacgctgaaaacagtatttacacccggccattcgcctgggcatcagtcaatactggtcaccttgcccaactcaggtccgatgctactgactattgatgcagcatacaccacggatcactgggaagaaaaagctctgccaggatttatgtcctcagccgttgagacggtgcgttcggtgcagaagatgcgcatgttggctagccgcacaagtgcgcaagtggtgacaggccatgacccggatgcctggcaaacgttcaggcacgcgcctgaatactacgattga

SEQ ID NO: 178 - DNA, 771 bp, Agrobacterium tumefaciens
atgcttcagtcgggtacgctgaaatgcaaggtacacaacattaagatgaaccaggggaacggtgcagactatgagatccccgttccgtttttcctgattacccatccggccgggcacaccgtgatcgacggcggcaacgcgattgaagttgcaacagatccgcgtggccattggggcggcatctgcgatgtctattggccagtactggacaaggaccagggctgcgttgaccagatcaaggcgcttggtttcgatccggccgatgtcaaatatgttgtgcagtcgcacctgcatctcgatcataccggcgccatcggtcgcttccccaacgcaacccacatcgtgcagcgctctgaatatgaatatgcctttacgcccgactggtttgctggcggcggctatatccgcaaggacttcgacaagccgggtctgaagtggcagttcctcaacggtgcgcaggacgattattacgatgtttacggcgacggcacgctcaccacgatcttcacgcccggtcatgcgcccggccaccagtccttcctggtgcgcctgccaaacagcaaaccgcttctcctgacgatcgatgctgcctacacactggaccactgggaagagaaggctttgcctggcttccttgcctcgaccgttgacacggtccgttctgttcagaagctccgcacctatgccgaaaagcatgatgcgacagtcgtcaccggccatgaccctgacgcctgggcgaacttcaagaaggctcccgaattttacgcgtaa

SEQ ID NO: 179 - protein, 263 aa, Yersinia intermedia
MTDIRLYMFQTGSLKCKVHNIKMNQGGGADYEIPVPFFLLTHPDGHTLIDGGNAVETATDPKGYWGGITEVYWPVMREDEGCVAQLKKMGINPEDIRYVLQSHLHLDHTGAIGRFPNATHIVQRREYEYAFTPDWFAAGGYIRNDFDRPGLKWAFLEGENNDFYDIYGDGTLKTVFTPGHSPGHQSILVTLPNSGPMLLTIDAAYTTDHWEEKALPGFMSSAVETVRSVQKMRMLASRTSAQVVTGHDPDAWQTFRHAPEYYD

SEQ ID NO: 180 - protein, 256 aa, Agrobacterium tumefaciens
MLQSGTLKCKVHNIKMNQGNGADYEIPVPFFLITHPAGHTVIDGGNAIEVATDPRGHWGGICDVYWPVLDKDQGCVDQIKALGFDPADVKYVVQSHLHLDHTGAIGRFPNATHIVQRSEYEYAFTPDWFAGGGYIRKDFDKPGLKWQFLNGAQDDYYDVYGDGTLTTIFTPGHAPGHQSFLVRLPNSKPLLLTIDAAYTLDHWEEKALPGFLASTVDTVRSVQKLRTYAEKHDATVVTGHDPDAWANFKKAPEFYA

SEQ ID NO: 181 - protein, 8 aa, Artificial Sequence
  Description of Artificial Sequence: Synthetic peptide
EGYDVFEA

SEQ ID NO: 182 - DNA, 69 bp, Artificial Sequence
  Description of Artificial Sequence: Synthetic primer
atgatgttttcgaagcggaaggctatgatgttttcgaagcgacagatggcgcggaaatgcatcagatcc

SEQ ID NO: 183 - DNA, 71 bp, Artificial Sequence
  Description of Artificial Sequence: Synthetic primer
tttccgcgccatctgtcgcttcgaaaacatcatagccttccgcttcgaaaacatcatagccttccgcttcg

SEQ ID NO: 184 - DNA, 24 bp, Artificial Sequence
  Description of Artificial Sequence: Synthetic primer
taatgatatttcgcccgactgcgc

SEQ ID NO: 185 - DNA, 26 bp, Artificial Sequence
  Description of Artificial Sequence: Synthetic primer
aatgaacggtatttatttgcaagcgg

SEQ ID NO: 186 - DNA, 1963 bp, Artificial Sequence
  Description of Artificial Sequence: Synthetic polynucleotide
taatgatatttcgcccgactgcgcgcagtggtggcgacagtgaaatcgacatcgtgtaacgattcagccaatgtcgggaaaactttaatattatcaataatatcaccagatccatgtgcgacccagcgggtggctggctccaggtgtgcctgactatcgacaatccgcagatcgctaaaccccatcgttttcattgcccgcgccgctgccccaatattttctgctctggcgggtgcgaccagaataatcgttatacgcatattgccactcttcttgatcaaataaccgcgaaccgggtgatcactgtcaacttattacgcggtgcgaatttacaaattcttaacgtaagtcgcagaaaaagccctttacttagcttaaaaaaggctaaactatttcctgactgtactaacggttgagttgttaaaaaatgctacatatccttctgtttacttaggataattttataaaaaataaatctcgacaattggattcaccacgtttattagttgtatgatgcaactagttggattattaaaataatgtgacgaaagctagcatttagatacgatgatttcatcaaactgttaacgtgctacaattgaacttgatatatgtcaacgaagcgtagttttattgggtgtccggcccctcttagcctgttatgttgctgttaaaatggttaggatgacagccgtttttgacactgtcgggtcctgagggaaagtacccacgaccaagctaatgatgttgttgacgttgatggaaagtgcatcaagaacgcaattacgtactttagtcatgttacgccgatcatgttaatttgcagcatgcatcagcaggtcagggacttttgtacttcctgtttcgatttagttggcaatttaggtagcaaacatgcagaccccgcacattcttatcgttgaagacgagttggtaacacgcaacacgttgaaaagtattttcgaagcggaaggctatgatgttttcgaagcggaaggctatgatgttttcgaagcgacagatggcgcggaaatgcatcagatcctctctgaatatgacatcaacctggtgatcatggatatcaatctgccgggtaagaacggtcttctgttagcgcgtgaactgcgcgagcaggcgaatgttgcgttgatgttcctgactggccgtgacaacgaagtcgataaaattctcggcctcgaaatcggtgcagatgactacatcaccaaaccgttcaacccgcgtgaactgacgattcgtgcacgcaacctactgtcccgtaccatgaatctgggtactgtcagcgaagaacgtcgtagcgttgaaagctacaagttcaatggttgggaactggacatcaacagccgttcgttgatcggccctgatggcgagcagtacaagctgccgcgcagcgagttccgcgccatgcttcacttctgtgaaaacccaggcaaaattcagtcccgtgctgaactgctgaagaaaatgaccggccgtgagctgaaaccgcacgaccgtactgtagacgtgacgatccgccgtattcgtaaacatttcgaatctacgccggatacgccggaaatcatcgccaccattcacggtgaaggttatcgcttctgcggtgatctggaagattaatcggctttaccaccgtcaaaaaaaacggcgctttttagcgccgtttttatttttcaaccttatttccagatacgtaactcatcgtccgttgtaacttctttactggctttcattttcggcagtgaaaacgcataccagtcgatattacgggtcacaaacatcatgccggccagcgccaccaccagcacactggttcccaacaacagcgcgctatcggcagagttgagcagtccccacatcacaccatccagcaacaacagcgcgagggtaaacaacatgctgttgcaccaacctttcaataccgcttgcaaataaataccgttcatta

SEQ ID NO: 187 - DNA, 498 bp, Artificial Sequence
  Description of Artificial Sequence: Synthetic polynucleotide
atgggtttgttcgataaactgaaatctctggtttccgacgacaagaaggataccggaactattgagatcattgctccgctctctggcgagatcgtcaatatcgaagacgtgccggatgtcgtttttgcggaaaaaatcgttggtgatggtattgctatcaaaccaacgggtaacaaaatggtcgcgccagtagacggcaccattggtaaaatctttgaaaccaaccacgcattctctatcgaatctgatagcggcgttgaactgttcgtccacttcggtatcgacaccgttgaactgaaaggcgaaggcttcaagcgtattgctgaagaaggtcagcgcgtgaaagttggcgatactgtcattgaatttgatctgccgctgctggaagagaaagccaagtctaccctgactccggttgttatctccaacatggacgaaatcaaagaactgatcaaactgtccggtagcgtaaccgtgggtgaaacccataagcgctaa

SEQ ID NO: 188 - protein, 431 aa, Porphyromonas gingivalis
MQWQELYRQRVCSADEAVVDSLKPGTKVVFGHAAAAPVRFSQAMYRQREKLENITVFHMLYFGDAPHLAPEMRSHVHPTLNFLEGNSRPASRDRRVDFIPCHFHEVPELFRQGFFPLDVAVVQVSTPNEEGYCSFGVSCDYTKAAAECAPVVVAEVNKQMPFIGGENLIHISKLTHIIEVDEPIAEVLPPAISDLELRIGQNCASLIKDGDTLQLGIGGIPDAVLRALEGHKDLGIHTEMFTDGVMRMIRKGIINGKKKTLHPEKVVTSLIFGSKELYDFVNNNPVIECYPVDYINNPDVIGKNDRMVSINSCLEMDLMGQAASESIGYEQFSGSGGQVDFLRGAKRSKGGISIMAFPSTAKKGTESRIVPILKEGACVTTGRNEVDYVVTEYGVARLRGATLRQRAEALTAIAHPDFRPALEEEIRRRFE

SEQ ID NO: 189 - protein, 431 aa, Roseiflexus castenholzii
MPRSLTAGRREMTAEEAVELIESNHRVYIGGGCGVPIPLLDALVARAPELRNVEIIHMLTAGEDPTTAPELAASFRHNALFIGHNTRRAVNEGRADFTPIFLGEIPKLFRQGILPLDVAMIQVSPPDRHGFCSLGVEVGCTLPAARTAKIVIAEVNARMPRTLGDSFIHISRLTALVESDRPLLELPQGETNSVAQAIGRHIAELIPDGATLQLGIGAIPDAVLSNLHGKRHLGIHTELFSDGVIDLVEAGVIDGELKTIHQGKVVAGFILGSQRCFDWAHNNAMVEMHPTDYVNDPFVIAQHKNMVAVNSALQVDLTGQVCADSIGTRLYSGVGGQVDFIRGASRSEGGIPIIAISSTARDGTISRIVPTLDVGAGVVTSRYDVHFVVTEYGVADLYGRTLAQRARALINIAHPAFRDQLTEAAKKLHYI

SEQ ID NO: 190 - protein, 436 aa, Lachnospiraceae bacterium
MNWQEEYKRRLCSAEEAVQHIHSGDTVFLGHAVAESSLLVDAMVQNATAYQDVRIIHMTNLGSGAYTQPGMESHFHVSPFFLGATVRAAVAEGRGDFIPCFFHEIPQLIRERRVPCDVLMTQVSPSDEKGYCSLGVSADYTYQALKSARTVIAHVNDQYPYTFGTKVHVTELDYIVEQSAPLYESKPPKIGEVEEKIGRCCASLIRDGATLQLGIGAIPDAVMMFLGDKHDLGIHSEMISDGTMELYQKGVITNQRKNLDRGKMTITFAMGTKKLYQFLDKNPDVLVKPVDYVNHPVTIMKEHDMISINSAIQVDLQGQVDAEAIGLRQFSGVGGQVDFIRGAAMGGGTSIIAMPSTTQKKDGTLISKIVPFLDQGAPVTTSRNDVDYIITEYGIAHLKGETLRDRAWALISISHPSVRDSLAEEFERRFHQNYRA

SEQ ID NO: 191 - protein, 436 aa, Fusobacterium necrophorum
MSKNWREVYKDKIVTADEAVKQIKSGDRLIFSHACGEAQEITDALLRNKESYEKVEIIHLVPMGKGEYAQEENQKYFYHNSFFGGGSTRKAINGTYGDFTPSFFFEIPNLFRKNGKLPLDVAIIQVSAPDEHGYCSYGISCDYTKGAAENAKIVIAQVNKYMPRTLGENFTHLSAIDSIVEYDQPILQLNPPKIGEVEKKIGEYCAGLIQDGDTLQLGIGAIPDAVLTFLKEKKHLGIHSEMISDGVVDLILAGVIDNSQKTIHKNKCIVSFLMGSQKLYDYVHNNPGVELYPVDYVNHPFVIAQNDNMVSINSALQVDLMGQVNAESMGAKQFSGTGGQVDFVRGAAMSKGGRSIIAMPSTAAKGTISKIVMNLDVGATVTTSRNDVDYIITEYGIAELKGKTLRERAKALIAIAHPDFREQLTKQALEKFQRLE

SEQ ID NO: 192 - protein, 429 aa, Clostridium kluyveri
MEWEEIYKEKLVTAEKAVSKIENHSRVVFAHAVGEPVDLVNALVKNKDNYIGLEIVHMVAMGKGVYTKEGMQRHFRHNALFVGGSTRDAVNSGRAVYTPCFFYEVPSLFKEKRLPVDVALIQVSEPDKYGYCSFGVSNDYTKPAAESAKLVIAEVNKNMPRTLGDSFIHVSDIDYIVEASHPLLELQPPKLGDVEKAIGENCASLIEDGATLQLGIGAIPDAVLLFLKNKKNLGIHSEMISDGVMELVKAGVINNKKKTLHPGKIVVTFLMGTKKLYDFVNNNPMVETYSVDYVNNPLVIMKNDNMVSINSCVQVDLMGQVCSESIGLKQISGVGGQVDFIRGANLSKGGKAIIAIPSTAGKGKVSRITPLLDTGAAVTTSRNEVDYVVTEYGVAHLKGKTLRNRARALINIAHPKFRESLMNEFKKRF

SEQ ID NO: 193 - protein, 436 aa, Clostridium acetobutyricum
MDWKKIYEDRTCTADEAVKSIKSGDRVLFAHCVAEPPVLVEAMVANAAAYKNVTVSQMVTLGKGEYSKPEYKENFTFEGWFTSPSTRGSIAEGHGQFVPVFFHEVPSLIRKDIFHVDVFMMVSPPDHNGFCCVGVSSDYTMQAIKSAKIVLAEVNDQVPVVYGDTFVHVSEIDKFVETSHPLPEIGLPKIGEVEAAIGKHCASLIEDGSTLQLGIGAIPDAVLSQLKDKRHLGIHSEMISDGVVDLYEAGVIDCSQKSIDKGKMAITFLMGTKRLYDFAANNPKVELKPVDYINHPSVVAQCSKMVCINSCLQVDFMGQIVSDSIGTKQYSGVGGQVDFVRGASMSIDGKGKAIIAMPSVAKKKDGSMISKIVPFIDHGAAVTTSRNDADYVVTEYGIAMKGKSLQDRARALINIAHPDFKDELKAEFEKRFNAAF

SEQ ID NO: 194 - protein, 436 aa, Clostridium beijerinckii
MSKISWKDLYKSKVVTADEAVRKIKSNDRVVTGHACGEPKEIIDAMVRNKDLYENVEIVHMVSMGKSEYCKPEMAVNFRHNSIFAGGTTREAIFDGRADFTPCFFSEVPKMFREGTLPVDVALVQLSVPDEHGYCSFGVSNDYTKPAAEAAKIVIAELNEKMPRTLGDSFIHVSDIDYIVETSNDIIELKPPKIGEVEKAIGENCAKLIEDGSTLQLGIGAIPDAVLLFLKGKKDLGIHSEMISDGVVELIEAGVITNKAKTLHPGKSVVTFLMGTKRLYDYVNGNPSVAMYPVDYVNNPCVIAENYKMVSINSCIQVDLMGQVAADTIGLKQFSGVGGQVDFVRGAAMAKGGKSIIAMPSTASKGKLSRIVPILDEGATVTTSRNDIHYVVTEFGIAELKGKTLKERAKALINVAHPDFRDALIKEWEKRFKVKF

SEQ ID NO: 195 - protein, 438 aa, Eubacterium saphenum
MDWKKIYEEKRCTAKEAVQSIKSNDRVVFAHAVAEPTSLVDAMVENKEAYENVTISHMFSFGKGEYSLPENSKHFRYEGWFNSPNTRKSTELGHGDYVPAFFHQVPSLIRRGVLPVDVVMVSLSKPDAHGYCSTGVSSDYTMQAIKSAKVVLAEINDQVPKTFGESFVHISEIDKLVEHSHPLFELGLPKIGEVEEAIGKHCASLIEDGATLQLGIGAIPDAVLAQLKHKKDLGIHSEMISDGAVELFEAGVINNSKKSIDKGKMVVTFLMGTKRLYDFVNENPAVELRPVDYVNHPEVIAKSSNLVCINACLQVDFMGQVVSDTIGTRQFSGVGGQVDFVRGAAMAHDEKAKAIIAMPSVAVKKDGTKISKIVPFIDHGAAVTTSRHDTDYIVTEYGIAEMVGKTMKDRARSLINIAHPDFRDELKAEFEKRFNVKF

SEQ ID NO: 196 - protein, 433 aa, Clostridium sp.
MSWQELYQQKRMTAEQAVSHIKSGDRVVVAHATGEPSALIDAMVKNADAYRNVEIVHMVAMGKGEYCLPEYTENFRHNSLFLGASTRDAIAKGRGDFTPVYFSQIPDLLREELHPNVALLHLSPPDEHGYCSYGVSVDYTKPAAEIADLRIAQINPNMPRTLGDSFIHVSELDCIVEVDDPIIELGQAKIGETECAIGEHCASLIQDGDCLQLGIGAIPDAVLLFLKEKKDLGIHSEMFSDGVVELVEAGVITNRRKTLHKGQCVVTFLMGSKRLYDYVNNNPSVAMYPVDYVNNPAVIAKNDNLVSINSCIQVDLMGQVVSDSIGPRQFSGVGGQVDFVRGANLSRGGKSIMAMPSSLVKKDGTRVSKIAVQIDAGAAVTTSRYDVNYIVTEFGVAKLKGKTLRDRAKALIEIAHPDFREELMEEFHRRFGV

SEQ ID NO: 197 - protein, 438 aa, Clostridium aminobutyricum
MDWKKIYEDRTCTADEAVKSIKSGDRVLFAHCVAEPPVLVEAMVANAAAYKNVTVSHMVTLGKGEYSKPEYKENFTFEGWFTSPSTRGSIAEGHGQFVPVFFHEVPSLIRKDIFHVDVFMVMVSPPDHNGFCCVGVSSDYTMQAIKSAKIVLAEVNDQVPVVYGDTFVHVSEIDKFVETSHPLPEIGLPKIGEVEAAIGKHCASLIEDGSTLQLGIGAIPDAVLSQLKDKKHLGIHSEMISDGVVDLYEAGVIDCSQKSIDKGKMAITFLMGTKRLYDFAANNPKVELKPVDYINHPSVVAQCSKMVCINACLQVDFMGQIVSDSIGTKQFSGVGGQVDFVRGASMSIDGKGKAIIAMPSVAKKKDGSMISKIVPFIDHGAAVTTSRNDADYVVTEYGIAEMKGKSLQDRARALINIAHPDFKDELKAEFEKRFNAAF

SEQ ID NO: 198 - protein, 433 aa, Clostridium carboxidivorans
MDWKKLYKSKLVSAKEAVSNIKSNSRVVVSIAVAEPTELIDALVANKENYENVEVVHMVDMGKSEYAQEGMEKYFKYNSIFVGASTKDAVNSGRSDFTPCCFYELPRLFEEGYLPVDVVLIQVSKPDKHGYCSFGVSNDYTKPAADCAKMVIAEVNENMPRVLGDSFIHISDIDYIVETSHPIMELKQPKIGKIEEAIGEYCASLIEDGSTLQLGIGAIPDAVLLFLKDKKDLGIHSEMISDGVVDLVESGVINNKEKTLNPGKIVVTFFMGTKKLYDFIDDNPMVESYPVSYVNDPTVIMKNSKMISINSCVEVDLMGQVCSESIGMNQISGIGGQVDFIRGANMCKDGKAIIAIPSTAAKGKVSRIVPLIEKGTPITTSRTDVDYIITEYGIARLKSKSLKERARALINIAHPDFRAWLIDEYEKRFKTKF

SEQ ID NO: 199 - protein, 431 aa, Artificial Sequence
  Description of Artificial Sequence: Synthetic polypeptide
MQWQELYRQRVCSADEAVVDSLKPGTKVVLGGAAAAPVRFSQAMYRQREKLENITVFQMLYFGDAPHLAPEMRSHVHPTLNFLEGNSRPASRDRRVDFIPCHFHEVPYLFRQGFFPLDVAVVQVSTPNEEGYCSFGVSCDYTKAAAECAPVVVAEVNKQMPFIGGENLIHISKLTHIIEVDEPIAEVLPPAISDLELRIGQNCASLIKDGDTLQLGIGGIPDAVLRALEGHRDLGIHTEMFTDGVMRMIRKGIINGKKKTLHPEKVVTSLIFGSKELYDFVNNNPVIECYPVDYINNPDVIGKNDRMVSINSCVEMDLMGQAASESIGYEQYSGSGGQVDFLRGAKRSKGGISIMAFPSTAKKGTESRIVPILKEGACVTTGRNEVDYVVTEYGVARLRGATLRQRAEALTAIAHPDFRPALEEEIRRRFE

SEQ ID NO: 200 - protein, 431 aa, Artificial Sequence
  Description of Artificial Sequence: Synthetic polypeptide
MPRSLTAGRREMTAEEAVELIESNHRVYLGHGAGVPIPLLDALVARAPELRNVEIIQMLTAGEDPTTAPELAASFRHNALFIGHNTRRAVNEGRADFTPIFLGEIPYLFRQGILPLDVAMIQVSPPDRHGFCSLGVEVGCTLPAARTAKIVIAEVNARMPRTLGDSFIHISRLTALVESDRPLLELPQGETNSVAQAIGRHIAELIPDGATLQLGIGAIPDAVLSNLHGKRHLGIHTELFSDGVIDLVEAGVIDGELKTIHQGKVVAGFILGSQRCFDWAHNNAMVEMHPTDYVNDPFVIAQHKNMVAVNSAVQVDLTGQVCADSIGTRLYSGVGGQVDFIRGASRSEGGIPIIAISSTARDGTISRIVPTLDVGAGVVTSRYDVHFVVTEYGVADLYGRTLAQRARALINIAHPAFRDQLTEAAKKLHYI

SEQ ID NO: 201 - protein, 436 aa, Artificial Sequence
  Description of Artificial Sequence: Synthetic polypeptide
MNWQEEYKRRLCSAEEAVQHIHSGDTVFLGGAAAESSLLVDAMVQNATAYQDVRIIQMTNLGSGAYTQPGMESHFHVSPFFLGATVRAAVAEGRGDFIPCFFHEIPYLIRERRVPCDVLMTQVSPSDEKGYCSLGVSADYTYQALKSARTVIAHVNDQYPYTFGTKVHVTELDYIVEQSAPLYESKPPKIGEVEEKIGRCCASLIRDGATLQLGIGAIPDAVMMFLGDKRDLGIHSEMISDGTMELYQKGVITNQRKNLDRGKMTITFAMGTKKLYQFLDKNPDVLVKPVDYVNHPVTIMKEHDMISINSAVQVDLQGQVDAEAIGLRQYSGVGGQVDFIRGAAMGGGTSIIAMPSTTQKKDGTLISKIVPFLDQGAPVTTSRNDVDYIITEYGIAHLKGETLRDRAWALISISHPSVRDSLAEEFERRFHQNYRA

SEQ ID NO: 202 - protein, 436 aa, Artificial Sequence
  Description of Artificial Sequence: Synthetic polypeptide
MSKNWREVYKDKIVTADEAVKQIKSGDRLILSGAAGEAQEITDALLRNKESYEKVEIIQLVPMGKGEYAQEENQKYFYHNSFFGGGSTRKAINGTYGDFTPSFFFEIPYLFRKNGKLPLDVAIIQVSAPDEHGYCSYGISCDYTKGAAENAKIVIAQVNKYMPRTLGENFTHLSAIDSIVEYDQPILQLNPPKIGEVEKKIGEYCAGLIQDGDTLQLGIGAIPDAVLTFLKEKRHLGIHSEMISDGVVDLILAGVIDNSQKTIHKNKCIVSFLMGSQKLYDYVHNNPGVELYPVDYVNHPFVIAQNDNMVSINSAVQVDLMGQVNAESMGAKQYSGTGGQVDFVRGAAMSKGGRSIIAMPSTAAKGTISKIVMNLDVGATVTTSRNDVDYIITEYGIAELKGKTLRERAKALIAIAHPDFREQLTKQALEKFQRLE

SEQ ID NO: 203 - protein, 429 aa, Artificial Sequence
  Description of Artificial Sequence: Synthetic polypeptide
MEWEEIYKEKLVTAEKAVSKIENHSRVVLAGAAGEPVDLVNALVKNKDNYIGLEIVQMVAMGKGVYTKEGMQRHFRHNALFVGGSTRDAVNSGRAVYTPCFFYEVPYLFKEKRLPVDVALIQVSEPDKYGYCSFGVSNDYTKPAAESAKLVIAEVNKNMPRTLGDSFIHVSDIDYIVEASHPLLELQPPKLGDVEKAIGENCASLIEDGATLQLGIGAIPDAVLLFLKNKRNLGIHSEMISDGVMELVKAGVINNKKKTLHPGKIVVTFLMGTKKLYDFVNNNPMVETYSVDYVNNPLVIMKNDNMVSINSCVQVDLMGQVCSESIGLKQYSGVGGQVDFIRGANLSKGGKAIIAIPSTAGKGKVSRITPLLDTGAAVTTSRNEVDYVVTEYGVAHLKGKTLRNRARALINIAHPKFRESLMNEFKKRF

SEQ ID NO: 204 - protein, 438 aa, Artificial Sequence
  Description of Artificial Sequence: Synthetic polypeptide
MDWKKIYEDRTCTADEAVKSIKSGDRVLLAGCAAEPPVLVEAMVANAAAYKNVTVSQMVTLGKGEYSKPEYKENFTFEGWFTSPSTRGSIAEGHGQFVPVFFHEVPYLIRKDIFHVDVFMVMVSPPDHNGFCCVGVSSDYTMQAIKSAKIVLAEVNDQVPVVYGDTFVHVSEIDKFVETSHPLPEIGLPKIGEVEAAIGKHCASLIEDGSTLQLGIGAIPDAVLSQLKDKRHLGIHSEMISDGVVDLYEAGVIDCSQKSIDKGKMAITFLMGTKRLYDFAANNPKVELKPVDYINHPSVVAQCSKMVCINSCVQVDFMGQIVSDSIGTKQYSGVGGQVDFVRGASMSIDGKGKAIIAMPSVAKKKDGSMISKIVPFIDHGAAVTTSRNDADYVVTEYGIAEMKGKSLQDRARALINIAHPDFKDELKAEFEKRFNAAF

SEQ ID NO: 205 - protein, 436 aa, Artificial Sequence
  Description of Artificial Sequence: Synthetic polypeptide
MSKISWKDLYKSKVVTADEAVRKIKSNDRVVLGGAAGEPKEIIDAMVRNKDLYENVEIVQMVSMGKSEYCKPEMAVNFRHNSIFAGGTTREAIFDGRADFTPCFFSEVPYMFREGTLPVDVALVQLSVPDEHGYCSFGVSNDYTKPAAEAAKIVIAELNEKMPRTLGDSFIHVSDIDYIVETSNDIIELKPPKIGEVEKAIGENCAKLIEDGSTLQLGIGAIPDAVLLFLKGKRDLGIHSEMISDGVVELIEAGVITNKAKTLHPGKSVVTFLMGTKRLYDYVNGNPSVAMYPVDYVNNPCVIAENYKMVSINSCVQVDLMGQVAADTIGLKQYSGVGGQVDFVRGAAMAKGGKSIIAMPSTASKGKLSRIVPILDEGATVTTSRNDIHYVVTEFGIAELKGKTLKERAKALINVAHPDFRDALIKEWEKRFKVKF

SEQ ID NO: 206 - protein, 438 aa, Artificial Sequence
  Description of Artificial Sequence: Synthetic polypeptide
MDWKKIYEEKRCTAKEAVQSIKSNDRVVLAGAAAEPTSLVDAMVENKEAYENVTISQMFSFGKGEYSLPENSKHFRYEGWFNSPNTRKSTELGHGDYVPAFFHQVPYLIRRGVLPVDVVMVSLSKPDAHGYCSTGVSSDYTMQAIKSAKVVLAEINDQVPKTFGESFVHISEIDKLVEHSHPLFELGLPKIGEVEEAIGKHCASLIEDGATLQLGIGAIPDAVLAQLKHKRDLGIHSEMISDGAVELFEAGVINNSKKSIDKGKMVVTFLMGTKRLYDFVNENPAVELRPVDYVNHPEVIAKSSNLVCINSCLQVDFMGQVVSDTIGTRQYSGVGGQVDFVRGAAMAHDEKAKAIIAMPSVAVKKDGTKISKIVPFIDHGAAVTTSRHDTDYIVTEYGIAEMVGKTMKDRARSLINIAHPDFRDELKAEFEKRFNVKF

SEQ ID NO: 207 - protein, 433 aa, Artificial Sequence
  Description of Artificial Sequence: Synthetic polypeptide
MSWQELYQQKRMTAEQAVSHIKSGDRVVLAGAAGEPSALIDAMVKNADAYRNVEIVQMVAMGKGEYCLPEYTENFRHNSLFLGASTRDAIAKGRGDFTPVYFSQIPYLLREELHPNVALLHLSPPDEHGYCSYGVSVDYTKPAAEIADLRIAQINPNMPRTLGDSFIHVSELDCIVEVDDPIIELGQAKIGETECAIGEHCASLIQDGDCLQLGIGAIPDAVLLFLKEKRDLGIHSEMFSDGVVELVEAGVITNRRKTLHKGQCVVTFLMGSKRLYDYVNNNPSVAMYPVDYVNNPAVIAKNDNLVSINSCVQVDLMGQVVSDSIGPRQYSGVGGQVDFVRGANLSRGGKSIMAMPSSLVKKDGTRVSKIAVQIDAGAAVTTSRYDVNYIVTEFGVAKLKGKTLRDRAKALIEIAHPDFREELMEEFHRRFGV

SEQ ID NO: 208 - protein, 438 aa, Artificial Sequence
  Description of Artificial Sequence: Synthetic polypeptide
MDWKKIYEDRTCTADEAVKSIKSGDRVLLAGCAAEPPVLVEAMVANAAAYKNVTVSQMVTLGKGEYSKPEYKENFTFEGWFTSPSTRGSIAEGHGQFVPVFFHEVPYLIRKDIFHVDVFMVMVSPPDHNGFCCVGVSSDYTMQAIKSAKIVLAEVNDQVPVVYGDTFVHVSEIDKFVETSHPLPEIGLPKIGEVEAAIGKHCASLIEDGSTLQLGIGAIPDAVLSQLKDKRHLGIHSEMISDGVVDLYEAGVIDCSQKSIDKGKMAITFLMGTKRLYDFAANNPKVELKPVDYINHPSVVAQCSKMVCINSCVQVDFMGQIVSDSIGTKQFSGVGGQVDFVRGASMSIDGKGKAIIAMPSVAKKKDGSMISKIVPFIDHGAAVTTSRNDADYVVTEYGIAEMKGKSLQDRARALINIAHPDFKDELKAEFEKRFNAAF

SEQ ID NO: 209 - protein, 433 aa, Artificial Sequence
  Description of Artificial Sequence: Synthetic polypeptide
MDWKKLYKSKLVSAKEAVSNIKSNSRVVVSIAAAEPTELIDALVANKENYENVEVVQMVDMGKSEYAQEGMEKYFKYNSIFVGASTKDAVNSGRSDFTPCCFYELPRLFEEGYLPVDVVLIQVSKPDKHGYCSFGVSNDYTKPAADCAKMVIAEVNENMPRVLGDSFIHISDIDYIVETSHPIMELKQPKIGKIEEAIGEYCASLIEDGSTLQLGIGAIPDAVLLFLKDKRDLGIHSEMISDGVVDLVESGVINNKEKTLNPGKIVVTFFMGTKKLYDFIDDNPMVESYPVSYVNDPTVIMKNSKMISINSCVEVDLMGQVCSESIGMNQISGIGGQVDFIRGANMCKDGKAIIAIPSTAAKGKVSRIVPLIEKGTPITTSRTDVDYIITEYGIARLKSKSLKERARALINIAHPDFRAWLIDEYEKRFKTKF

SEQ ID NO: 210 - protein, 858 aa, Clostridium acetobutylicum
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQCTTANPRYPLISELKDIYIKSF

SEQ ID NO: 211 - protein, 389 aa, Clostridium tetani
MKRFTIPRDIYYGKGSLEVIKSIKGNKAVIVIGGGSMKRFGFLDKVENYLKEAGIETKLIEGVEPDPSVETVMKGAEIMREFKPDWIISIGGGSPIDAAKAMWLFYEHPDLTFEEAAQKVLCLPELRSKAKFMAIPSTSGTASEVTAFSVITDYKKQIKYPLADFNLTPDIAIVDPELAETMPAKLTAHTGMDALTHAIEAYVATENTSFTDPLALQAILMVKDYLIKSYEEDKEARERMHEAQCLAGMAFSNALLGITHSMAHKIGAVFDITHGCANAIFLPYVIQFNSKVCEERYANIAKYLGLEGESDKDLVNSLINFIRDLNKKLSIDNSLKEYGIDENEFKEKVEYMAHNAVLDACTGANPRKINEEEMKNMYTYAFNGKDIDF

SEQ ID NO: 212 - protein, 405 aa, Butyrivibrio proteoclasticus
MSRFTLPRDIYHGKGALEALKTLEGKRAIVCVGGSSMKKGGFLQKVEDYLKEAGMEVELFEGIEPDPSVETVMKGAEAMQKFQPDWIVAIGGGSPIDAAKAMWIKYEYPETTFEDMCKVFGLPKLRTKAHFCAIPSTSGTATEVTAFSIITDYQKGIKYPIADFEITPDVAIVDPELTHTMPIKLVAHTGMDAMTHAIEAYVSTANCDYTDGLAIHAIEMIQANLVKSYNGDMESRDAMHNAQCLAGMAFSNALLGIVHSMAHKTGAVFADKGAHIIHGAANAMYLPKVIAFNAKDETAKKRYGVIADYMHLGGSNDDEKVKLLIDYLRKMNDDLNIPHSINHYGADGLPADQGFVAEDVFLERLHDIAANAILDACTGSNPRQPSQEEMEKLLKCCYYDTEVDF

SEQ ID NO: 213 - protein, 391 aa, Anaerostipes caccae
MGRFTLPRDLYFGKGSLETLKTLDGKKAVLVLGGGSMKRFGFVDQVVDYLKEAGIETKLIEGVEPDPSVETVFKGAEVMRDFEPDWIIAMGGGSPIDAAKAMWIFYEHPETTFDDVKDPFTVPPLRNKAKFLAIPSTSGTATEVTAFAVITDYSSGIKYPLADFEITPDIAIVDPALAETMPPKLTSYTGMDALTHAIEAYVAGLHSPFSDPLAMEAIEMVFDNLKASYEGDMTARENMHYAQCLAGMSFSNALLGIVHSLAHKTGAVFDTGHITHGCANAIYLPYVIQFNAKVCEERYAAIARRIGLPGNSDKALTLSLIEAIREMNKKLNIVSNLKDFGINEEEFNQKKRMIAERAVADACTGSNPRETSVDDMEKVLECIYYGKDVTF

SEQ ID NO: 214 - protein, 388 aa, Lachnospiraceae bacterium
MARFTLPRDLYWGKGSLENLKTLQGKKAVLVLGGGSMKRFGFVDKAVSYLKEAGIETRLFENVEPDPSVETVMKGAEFMREFEPDWIIAMGGGSPIDAAKAMWVFYEYPECTFEEILTPFSFPELRKKAKFCAIPSTSGTATEVTAFSVITDYAKGIKYPLADFNITPDVAIVDPELAETMPKHLVAYTGMDALTHAIEAYVSTLHGTFTDPLALKAIQIVNDELTKSYDGDMASREEMHYGQCLAGMAFSNALLGIVHSMAHKTGAAFSTGHITHGLANAMYLPYVIKYNAKEAEAKKRYETIAAYLGLEASVDALCNRIVELNNYMGIPNTLKEFGIKEDEFKEKISEIAKNAVGDACTGSNPRSIDPETMEKLFTYIYDGKEVDF

SEQ ID NO: 215 - protein, 388 aa, Clostridium celatum
MARFTLPRDIYHGNGSLEVLKTLKGKKAVVVVGGGSMKRFGFLEKVENYLKEAGLEVRLIEGVEPDPSVETVMNGAAVMREFEPDWIVAMGGGSPIDAAKAMWIFYEYPDFTFEEAVVPFGLPELRQKAKFVAIPSTSGTATEVTAFSVITDYKAKIKYPLADFNITPDIAIVDPELAQTMPAKLVAHTGMDALTHAIEAYTASLKSNFSDPLALKAIEMINENLVKSFNGDKNARDLMHEAQCLAGMAFSNALLGIVHSMAHKTGAVFHIPHGCANAIFLPYVIQYNRSECEERYADIAKVLKLEGNTNAELTDSLITKINEFNKELNIPATMQEYGVNEEEFLANLKNVAHNAVLDACTGSNPRTIDDETMEKLLSCTFYGNKVDF

SEQ ID NO: 216 - protein, 388 aa, Clostridium carboxidivorans
MSRFTLPRDIYFGENTLETLKTLKGKKAIIVVGGGSMKKFGFLQKVEEYLKEAGMEIKLIEGVEPDPSVETVMKGAEIMRDFEPDWIVSIGGGSPIDAAKAMWIFYEYPEFTFEQAVVPFGIPDLRQKAKFVAIPSTSGTATEVTAFSVITDYKAKIKYPLADFNLTPDVAIIDPALAQTMPAKLTAHTGMDALTHAIEAYVAGLRSYFSDPLAMQAIVMTKDNLIKSYEGDKEARDEMHIAQCLAGMAFSNALLGITHSMAHKTGAVFHIPHGCANAIFLPYVIDFNKKTCKDRYATIAKTLGLAGNTDDELVDALTSMIQEMNKKMDIPLNLKEYGVTEEDFNENLDFIAHNAVLDACTGSNPRPITEEEMKKVFKCTFTGEKVNF

SEQ ID NO: 217 - protein, 388 aa, Clostridium butyricum
MARFTLPRDIYHGEGSLEVLKTLKGKKAFVVVGGGSMKRFGFLQKVENYLKEAGMEVELFEGVEPDPSVETVMKGAEAMRKFQPDWIVAMGGGSPIDAAKAMWIFYEYPDFTFEQAVVPFGLPELRQKAKFVAIPSTSGTATEVTAFSVITNYTEKIKYPLADFNITPDIAIVDPELAQTMPAKLVAHTGMDALTHAIEAYTASLRSNFSDPLAIKAIEMVNENLVKSFEGDKTARNLMHEAQCLAGMAFSNALLGIVHSMAHKVGAVFHIPHGCANAIFLPYVIKYNRKVCEDRYADIARALKLEGNTDAELTDSLIKLINEFNDDLSIPHSMKEYGVEEADFKSNVKFIAHNAILDACTGSSPREIDEETMEKLFECTYYGTDVNF

SEQ ID NO: 218 - protein, 388 aa, Clostridium saccharoperbutylacetonicum
MARFTLPRDLYHGEGALEVLKTLKGKKAFVVVGGGSMKRFGFLQKVENYLKEAGMEVELFEGVEPDPSVETVMKGAEAMRNFEPDWIVSIGGGSPIDAAKAMWIFYEYPDFTFEQAVVPFGLPELRQKAKFVAIPSTSGTATEVTAFSVITNYTERIKYPLADFNITPDIAIIDPELAQTMPKTLTAHTGMDALTHAIEAYTASLRSNFSDPLAIKAIEMVNENLFKSYEGDKEARNLMHEAQCLAGMAFSNALLGIVHSMAHKVGAVFHIPHGCANAIFLPYVIQYNRTKCEERYADIARALKLEGNNDAELTDALIARINKLNEKLSIPSSMKEYGVTEEDFKANLSFIAHNAVLDACTGSNPREIDDATMEKLFECTFYGTKVEL

SEQ ID NO: 219 - protein, 388 aa, Clostridium beijerinckii
MARFTLPRDIYHGEGALEALKTLKGKKAFLVVGGGSMKRFGFLKQVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYSEKIKYPLADFNITPDIAIVDPALAQTMPKTLTAHTGMDALTHAIEAYTASLQSNFSDPLAIKAVEMVQENLIKSFEGDKEARNLMHEAQCLAGMAFSNALLGIVHSMAHKVGAVFHIPHGCANAIFLPYVIEYNRTKCENRYGDIARALKLKGNNDAELTDSLIELINGLNDKLEIPHSMKEYGVTEEDFKANLSFIAHNAVLDACTGSNPREIDDATMEKLFECTYYGTKVNL

SEQ ID NO: 220 - protein, 393 aa, Bacteroides capillosus
MSRFTLPRDIYYGANALEALKTLKGKKAVMVLGGGSMKRFGFVDKAIGYLKEAGIETKLFENVEPDPSVETVMKGAAMMREFEPDWIISMGGGSPIDAAKAMWAFYEYPETTFEDLITPFNFPELRQKAKFCAIPSTSGTATEVTAFSVITDYAKGIKYPLADFNITPDVAIVDPALAETMPPHLVAYTGMDALTHAIEAYVSTLHTVFTDPLAIEAIHIVEKDLIKSFKGDMTCREEMHYGQCLAGMAFSNALLGIVHSMAHKTGAAFSTGHITHGLANAMYLPYVIAYNSKADGVAERYADIARTMGVVGDTTAELVEGLRAKIRSMNDAMGIPNTLKDFGIIEDEFKEKLEAIATNAVGDACTGSNPRPIDPATMAKLFTCIYYGTEVDF

SEQ ID NO: 221 - protein, 394 aa, Clostridium perfringens
MGGIISMARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSFKGDMEARGEMHEAQCLAGMAFSNALLGIVHSMAHKVGAVFHIPHGCANAIFLPYVIKYNRKACEDRYAQIARHIGLKGESERELTDALIDLINKFNKELNIPSSMKEYGIDENEFKTNLKFIAHNAVLDPCTGSNPREIDDETMEKLYTCAYYGSDVDF

SEQ ID NO: 222 - protein, 858 aa, Artificial Sequence
  Description of Artificial Sequence: Synthetic polypeptide
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVDIPTTAGTGSEATPFAVITNDETGMKYGLTSYELTPNMAIIDTELMLNMPRKLTAAVGIDAFVHAIETYVSVMATDYTDELALRAIKMIFKYLPRAYKNGTNDIEAREKMAHASNIAGMAFANAFLGVCHSMAHQLGPMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQSTTANPRYPLISELKDIYIKSF

SEQ ID NO: 223 - protein, 389 aa, Artificial Sequence
  Description of Artificial Sequence: Synthetic polypeptide
MKRFTIPRDIYYGKGSLEVIKSIKGNKAVIVIGHASMKRFGFLDKVENYLKEAGIETKLIEGVEPDPSVETVMKGAEIMREFKPDWIISIGGGSPIDAAKAMWLFYEHPDLTFEEAAQKVLCLPELRHKAKFMDIPSTSGTASEVTAFSVITDYKKQIKYGLADFNLTPDIAIVDPELAETMPAKLTAHVGMDALTHAIETYVATERTSFTDPLALQAILMVHDYLIKSYEEDKEARERMHEAQCLAGMAFSNALLGITHSMAHQIGPVFDITHGCATAIFLPYVIQFNSKVCEERYANIAKYLGLEGESDKDLVNSLINFIRDLNKKLSIDNSLKEYGIDENEFKEKVEYMAHNAVLDACTGANPRKINEEEMKNMYTYAFNGKDIDF

SEQ ID NO: 224 - protein, 405 aa, Artificial Sequence
  Description of Artificial Sequence: Synthetic polypeptide
MSRFTLPRDIYHGKGALEALKTLEGKRAIVCVGHASMKKGGFLQKVEDYLKEAGMEVELFEGIEPDPSVETVMKGAEAMQKFQPDWIVAIGGGSPIDAAKAMWIKYEYPETTFEDMCKVFGLPKLRHKAHFCDIPSTSGTATEVTAFSIITDYQKGIKYGIADFEITPDVAIVDPELTHTMPIKLVAHVGMDAFTHAIETYVSTARCDYTDGLAIHAIEMIHANLVKSYNGDMESRDAMHNAQCLAGMAFSNALLGIVHSMAHQTGPVFADKGAHIIHGAATAMYLPKVIAFNAKDETAKKRYGVIADYMHLGGSNDDEKVKLLIDYLRKMNDDLNIPHSLNHYGADGLPADQGFVAEDVFLERLHDIAANAILDACTGSNPRQPSQEEMEKLLKCCYYDTEVDF

SEQ ID NO: 225 - protein, 391 aa, Artificial Sequence
  Description of Artificial Sequence: Synthetic polypeptide
MGRFTLPRDLYFGKGSLETLKTLDGKKAVLVLGHASMKRFGFVDQVVDYLKEAGIETKLIEGVEPDPSVETVFKGAEVMRDFEPDWIIAMGGGSPIDAAKAMWIFYEHPETTFDDVKDPFTVPPLRHKAKFLDIPSTSGTATEVTAFAVITDYSSGIKYGLADFEITPDIAIVDPALAETMPPKLTSYVGMDAFTHAIETYVAGLRSPFSDPLAMEAIEMVHDNLKASYEGDMTARENMHYAQCLAGMSFSNALLGIVHSLAHQTGPVFDTGHITHGCATAIYLPYVIQFNAKVCEERYAAIARRIGLPGNSDKALTLSLIEAIREMNKKLNIVSNLKDFGINEEEFNQKKRMIAERAVADASTGSNPRETSVDDMEKVLECIYYGKDVTF

SEQ ID NO: 226 - protein, 388 aa, Artificial Sequence
  Description of Artificial Sequence: Synthetic polypeptide
MARFTLPRDLYWGKGSLENLKTLQGKKAVLVLGHASMKRFGFVDKAVSYLKEAGIETRLFENVEPDPSVETVMKGAEFMREFEPDWIIAMGGGSPIDAAKAMWVFYEYPECTFEEILTPFSFPELRHKAKFCDIPSTSGTATEVTAFSVITDYAKGIKYGLADFNITPDVAIVDPELAETMPKHLVAYVGMDALTHAIETYVSTLRGTFTDPLALKAIQIVHDELTKSYDGDMASREEMHYGQCLAGMAFSNALLGIVHSMAHQTGPAFSTGHITHGLANAMYLPYVIKYNAKEAEAKKRYETIAAYLGLEASVDALCNRIVELNNYMGIPNTLKEFGIKEDEFKEKISEIAKNAVGDASTGSNPRSIDPETMEKLFTYIYDGKEVDF

SEQ ID NO: 227 - protein, 388 aa, Artificial Sequence
  Description of Artificial Sequence: Synthetic polypeptide
MARFTLPRDIYHGNGSLEVLKTLKGKKAVVVVGHASMKRFGFLEKVENYLKEAGLEVRLIEGVEPDPSVETVMNGAAVMREFEPDWIVAMGGGSPIDAAKAMWIFYEYPDFTFEEAVVPFGLPELRHKAKFVDIPSTSGTATEVTAFSVITDYKAKIKYGLADFNITPDIAIVDPELAQTMPAKLVAHVGMDAFTHAIETYTASLRSNFSDPLALKAIEMIHENLVKSFNGDKNARDLMHEAQCLAGMAFSNALLGIVHSMAHQTGPVFHIPHGCATAIFLPYVIQYNRSECEERYADIAKVLKLEGNTNAELTDSLITKINEFNKELNIPATLQEYGVNEEEFLANLKNVAHNAVLDASTGSNPRTIDDETMEKLLSCTFYGNKVDF

SEQ ID NO: 228 - protein, 388 aa, Artificial Sequence
  Description of Artificial Sequence: Synthetic polypeptide
MSRFTLPRDIYFGENTLETLKTLKGKKAIIVVGHASMKKFGFLQKVEEYLKEAGMEIKLIEGVEPDPSVETVMKGAEIMRDFEPDWIVSIGGGSPIDAAKAMWIFYEYPEFTFEQAVVPFGIPDLRHKAKFVDIPSTSGTATEVTAFSVITDYKAKIKYGLADFNLTPDVAIIDPALAQTMPAKLTAHVGMDAFTHAIETYVAGLRSYFSDPLAMQAIVMTHDNLIKSYEGDKEARDEMHIAQCLAGMAFSNALLGITHSMAHQTGPVFHIPHGCATAIFLPYVIDFNKKTCKDRYATIAKTLGLAGNTDDELVDALTSMIQEMNKKMDIPLNLKEYGVTEEDFNENLDFIAHNAVLDASTGSNPRPITEEEMKKVFKCTFTGEKVNF

SEQ ID NO: 229 - protein, 388 aa, Artificial Sequence
  Description of Artificial Sequence: Synthetic polypeptide
MARFTLPRDIYHGEGSLEVLKTLKGKKAFVVVGHASMKRFGFLQKVENYLKEAGMEVELFEGVEPDPSVETVMKGAEAMRKFQPDWIVAMGGGSPIDAAKAMWIFYEYPDFTFEQAVVPFGLPELRHKAKFVDIPSTSGTATEVTAFSVITNYTEKIKYGLADFNITPDIAIVDPELAQTMPAKLVAHVGMDAFTHAIETYTASLRSNFSDPLAIKAIEMVHENLVKSFEGDKTARNLMHEAQCLAGMAFSNALLGIVHSMAHQVGPVFHIPHGCATAIFLPYVIKYNRKVCEDRYADIARALKLEGNTDAELTDSLIKLINEFNDDLSIPHSLKEYGVEEADFKSNVKFIAHNAILDASTGSSPREIDEETMEKLFECTYYGTDVNF

SEQ ID NO: 230 - protein, 388 aa, Artificial Sequence
  Description of Artificial Sequence: Synthetic polypeptide
MARFTLPRDLYHGEGALEVLKTLKGKKAFVVVGHASMKRFGFLQKVENYLKEAGMEVELFEGVEPDPSVETVMKGAEAMRNFEPDWIVSIGGGSPIDAAKAMWIFYEYPDFTFEQAVVPFGLPELRHKAKFVDIPSTSGTATEVTAFSVITNYTERIKYGLADFNITPDIAIIDPELAQTMPKTLTAHVGMDAFTHAIETYTASLRSNFSDPLAIKAIEMVHENLFKSYEGDKEARNLMHEAQCLAGMAFSNALLGIVHSMAHQVGPVFHIPHGCATAIFLPYVIQYNRTKCEERYADIARALKLEGNNDAELTDALIARINKLNEKLSIPSSLKEYGVTEEDFKANLSFIAHNAVLDASTGSNPREIDDATMEKLFECTFYGTKVEL

SEQ ID NO: 231 - protein, 388 aa, Artificial Sequence
  Description of Artificial Sequence: Synthetic polypeptide
MARFTLPRDIYHGEGALEALKTLKGKKAFLVVGHASMKRFGFLKQVEDYLKEAGMEVELFEGVEPDPSVETVMKGAEAMRNFEPDWIVAMGGGSPIDAAKAMWIFYEYPDFTFEQAVVPFGLPDLRHKAKFVDIPSTSGTATEVTAFSVITNYSEKIKYGLADFNITPDIAIVDPALAQTMPKTLTAHVGMDAFTHAIETYTASLRSNFSDPLAIKAVEMVHENLIKSFEGDKEARNLMHEAQCLAGMAFSNALLGIVHSMAHQVGPVFHIPHGCATAIFLPYVIEYNRTKCENRYGDIARALKLKGNNDAELTDSLIELINGLNDKLEIPHSLKEYGVTEEDFKANLSFIAHNAVLDASTGSNPREIDDATMEKLFECTYYGTKVNL

SEQ ID NO: 232 - protein, 393 aa, Artificial Sequence
  Description of Artificial Sequence: Synthetic polypeptide
MSRFTLPRDIYYGANALEALKTLKGKKAVMVLGHASMKRFGFVDKAIGYLKEAGIETKLFENVEPDPSVETVMKGAAMMREFEPDWIISMGGGSPIDAAKAMWAFYEYPETTFEDLITPFNFPELRHKAKFCDIPSTSGTATEVTAFSVITDYAKGIKYGLADFNITPDVAIVDPALAETMPPHLVAYVGMDAFTHAIETYVSTLRTVFTDPLAIEAIHIVHKDLIKSFKGDMTCREEMHYGQCLAGMAFSNALLGIVHSMAHQTGPAFSTGHITHGLATAMYLPYVIAYNSKADGVAERYADIARTMGVVGDTTAELVEGLRAKIRSMNDAMGIPNTLKDFGIIEDEFKEKLEAIATNAVGDASTGSNPRPIDPATMAKLFTCIYYGTEVDF

SEQ ID NO: 233 - protein, 394 aa, Artificial Sequence
  Description of Artificial Sequence: Synthetic polypeptide
MGGIISMARFTLPRDIYHGKDSLEVLKSLEGKKAFIVIGHASMKRFGFLDKVLSYLKEANMETKVFEGVEPDPSVETVMKGAKEMEEFNPDWIVSIGGGSPIDAAKAMWIFYEYPDFTFEKAIVPFGLPKLRHKAKFVDIPSTSGTATEVTAFSVITDYKAKIKYGLADFEITPDIAIVDPSLAETMPEKLVAHVGMDAFTHAIETYTASLRSNFTDPLALKAIEMVHMHLVNSFKGDMEARGEMHEAQCLAGMAFSNALLGIVHSMAHQVGPVFHIPHGCATAIFLPYVIKYNRKACEDRYAQIARHIGLKGESERELTDALIDLINKFNKELNIPSSMKEYGIDENEFKTNLKFIAHNAVLDPSTGSNPREIDDETMEKLYTCAYYGSDVDF

SEQ ID NO: 234 - protein, 468 aa, Clostridium beijerinckii; identical to SEQ ID NO: 70

SEQ ID NO: 235 - protein, 467 aa, Clostridium botulinum
MERNLSVLSQTNDLKITKRTEGDKSNNKESYLGVFKKVENAITKAIYAQKKLSLYYTKEDRERIIKSIRKATLENKEILAKMIVDETHMGRYEDKILKHELVAKYTPGTEDLITTAWSGDQGLTLVEMSPYGVIGAITPSTNPTETVICNSIGMIAAGDSVVFNGHPGAKKCVAFAVDMINKAVIREGGPENLVTTVENPTMESLNVIMKHPYIKLLCGTGGPGLIKTLLNSGKKAIGAGAGNPPVIVDDSADIDKAAKNIIEGCSFDNNLPCIAEKEVFVFENVANDLIQNMIKNNAVLINENQVSKLLDLVLLERKDETLEYAINKKWVGKDAKLFLDKIGIKASDNVRCIICEVDANHPFVMTELMMPILPIVRVKDVDEAIECAKTAEQRKRHSAYMYSKNIDNLNRFEKEIDTTIFVKNAKSFAGVGFGAEGFTTFTIAGPTGEGITSARNFTRQRRCVLAG

SEQ ID NO: 236 - protein, 468 aa, Clostridium beijerinckii; identical to SEQ ID NO: 70

SEQ ID NO: 237 - protein, 468 aa, Clostridium saccharoperbutylacetonicum
MIKDTLVSITKDLKLKTNVENANLKNYKDDSSCFGVFENVENAISNAVHAQKILSLHYTKEQREKIITEIRKAALENKEILATMILEETHMGRYEDKILKHELVAKYTPGTEDLTTTAWSGDNGLTVVEMSPYGVIGAITPSTNPTETVICNSIGMIAAGNTVVFNGHPGAKKCVAFAVEMINKAIISCGGPENLVTTIKNPTMDSLDAIIKHPSIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYSINKKWVGKDAKLFLDEIDVESPSSVKCIICEVSASHPFVMTELMMPILPIVRVKDIDEAIEYAKIAEQNRKHSAYIYSKNIDNLNRFEREIDTTIFVKNAKSFAGVGYEAEGFTTFTIAGSTGEGITSARNFTRQRRCVLAG

SEQ ID NO: 238 - protein, 480 aa, Pelosinus fermentans
MSIDQALIEKITLEILTKMQTGAKAAPAGYGDGIFETVDEAVAAARKAYQELKTLSLEKREVLIKAMRDVAYENATILAQMAVDESGMGRVSDKIIKNQVAALKTPGTEDLTTQAWSGDNGLTLIEMGPYGVIGAITPTTNPTETVICNGIGMIAAGNTVFFSPHPTAKNTSMKIITLLNQAIVKAGGPNNLLTSVANPSIKAANEMMKHPGINMLVATGGPGVVKAVLSSGKKAIGAGAGNPPVIVDETADIEKAARDIVAGCSFDNNLPCIAEKEVIAIGSIADRLITYMQKYGAYLISGSNIDRLLNVIMTVQEEKIAEGCTDKPKRSYGINKDYVGKDAKYLLSKIGIDVPDSVRVVLCETPADHPFVIEELMMPVLPVVQVKDIDEAIEVAVRVEHGNRHTAAMHSKNVDHLTRFARAVETTIFVKNAPSYAGIGVGGEGFTSFTLAGPTGEGITSPRSFTRQRRCVLVDAFSIV

SEQ ID NO: 239 - protein, 468 aa, Clostridium beijerinckii
MNKDTLIPTTKDLKLKTNVENINLKNYKDNSSCFGVFENVENAINSAVHAQKILSLHYTKEQREKIITEIRKAALENKEVLATMILEETHMGRYEDKILKHELVAKYTPGTEDLTTTAWSGDNGLTVVEMSPYGVIGAITPSTNPTETVICNSIGMIAAGNAVVFNGHPGAKKCVAFAIEMINKAIISCGGPENLVTTIKNPTMESLDAIIKHPLIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYFINKKWVGKDAKLFSDEIDVESPSNIKCIVCEVNANHPFVMTELMMPILPIVRVKDIDEAVKYTKIAEQNRKHSAYIYSKNIDNLNRFEREIDTTIFVKNAKSFAGVGYEAEGFTTFTIAGSTGEGITSARNFTRQRRCVLAG

SEQ ID NO: 240 - protein, 527 aa, Caldalkalibacillus thermarum
MNMTEKDIEKIVQSVLHNVESALGKSASASPSVSAVSVASGEGIKPVQFKQVPVFQQETVKSPNRNRNLGGAEEKWGVFNHMEDAIEASYRAQMEFVKHFQLKDREKIITAIREAVLREKEVLARKVYEETKIGRYEDKVAKHELAALKTPGTEDLKTEAFSGDNGLTIVERAPYGLIGAVTPVTNPTETIINNAIGMLAAGNAVVFNVHPSSKRSCAYAVQLINKAITEAGGPHHLVTMVKEPTLDTLQTLIDSPKVKLLVGTGGPGLVQTLLKSGKKAIGAGAGNPPVIVDDTADLEHAARSIIEGAAFDNNLLCIAEKEVFVLESVADDLIFHMLNHGAYMLGQHEVEQVMAFALEEQGNEQNRGCGFNPQRHYQVSKDWIGQDARLFLEHIGVQPPTEVKLLICDVEFDHPFVQLEQMMPVLPIVRVKTLDEAIEKAVMAEHGNRHTAIMHSKNVDHLTKFARAIQTTLFVKNASSLAGVGYGGEGHTTMTIAGPTGEGVTSAKTFTRERRCVLAEGGFRIIG

SEQ ID NO: 241 - protein, 468 aa, Artificial Sequence
  Description of Artificial Sequence: Synthetic polypeptide
MNKDTLIPTTKLLKVKTNGENINLKNYKDNSSCKGVFENVEDALSSTVHARKILSGACGKEQREKIFSEIAKAALQNKEVLATMILEETHRGRYEDKILKHELRATVTPGTENLTTTAWSGDNGLTINAMWAMGPAGASTPLTNPTETVICNSIGCIVGGNAVAFNPHPCAGKCVAYGVEMINMAIKGCGGPLNLVTTIMNPTLESLAAICKHPMIQLLCGTGGPRLVAVILQGGKKAIGSSRGNPPTIVDSFADIERTSRSIIISCSLDNNIPCIAETSLFVPENVLKDVISVFLKLNAVIINEDQVSLLIDLVLAKNNETQEYFKNKKWVAKDAKLFLDEIDVESPWNVKNIACEVNENHPFVMTELLMPILPIVRVKDIYEAIKYAKIAEQPHKFSAMIYSKHIDNLNRFEREIDTTIFVKNAKSFAGVGYEAEGFTTFTIAGSTGEGITSARNFTRQRRCVLAG

SEQ ID NO: 242 - protein, 465 aa, Artificial Sequence
  Description of Artificial Sequence: Synthetic polypeptide
MERNLSVLSQTNLKPTKRTEGDKSNNKESYKGVFKKVEDALTKTIYARKKLSGACGKEDRERFSKSIAKATLENKEILAKMIVDETHRGRYEDKILKHELRATVTPGTENLITTAWSGDQGLTINAMWAMGPAGASTPLTNPTETVICNSIGCIVGGDSVAFNPHPGAGKCVAYGVDMINMAVKSEGGPLNLVTTVMNPTLESLAVICKHPMIQLLCGTGGPRLIAVILQGKKAIGSSRGNPPTIVDSFADIDRTSKNIIISCSLDNNIPCIAETSLFVPENVLNKVIQVFIKLNAVLINENQVSLLLDLVLLARKDETLEYAKNKKWVAKDAKLFLDKIGIKASWNVRNIACEVDENHPFVMTELLMPILPIVRVKDVYEAIECAKTAEQPKRFSAMMYSKHIDNLNRFEKEIDTTIFVKNAKSFAGVGFGAEGFTTFTIAGPTGEGITSARNFTRQRRCVLAG

SEQ ID NO: 243 - protein, 468 aa, Artificial Sequence; identical to SEQ ID NO: 241
  Description of Artificial Sequence: Synthetic polypeptide

SEQ ID NO: 244 - protein, 468 aa, Artificial Sequence
  Description of Artificial Sequence: Synthetic polypeptide
MIKDTLVSITKLLKPKTNVENANLKNYKDNSSCKGVFENVEDALSNTVHARKILSGACGKEQREKFSTEIAKAALENKEILATMILEETHRGRYEDKILKHELRATVTPGTENLTTTAWSGDNGLTINAMWAMGPAGASTPLTNPTETVICNSIGCIVGGNTVAFNPHPGAGKCVAYGVEMINMAIKGCGGPLNLVTTIMNPTLDSLAAICKHPMIQLLCGTGGPRLVAVILQGGKKAIGSSRGNPPTIVDSFADIERTGKSIIISCSLDNNIPCIAETSLFVPENVLKDVISVFLKLNAVIINEDQVSLLIDLVLAKNNETQEYSKNKKWVAKDAKLFLDEIDVESPWSVKCIACEVSESHPFVMTELLMPILPIVRVKDIYEAIEYAKIAERPHKFSAMIYSKHIDNLWRFERGADSTIFVKNGLSLAGVGYEAPGFTSFTIAVPTGEGMTSAANFTRQRRTVNAN

SEQ ID NO: 245 - protein, 480 aa, Artificial Sequence
  Description of Artificial Sequence: Synthetic polypeptide
MSIDQALIEKITLEILTKMQTGAKAAPAGYGDGIFETVDDALAATRKARQELKGCGLEKREVFSKAMADVAYENATILAQMAVDESGRGRVSDKIIKNQVRATVTPGTENLTTQAWSGDNGLTINAMWAMGPAGASTPLTNPTETVICNGIGCIVGGNTAFFSPHPTAGNTSMYGITLLNMAIKGAGGPLNLLTSVMNPSLKAAAEMCKHPMIQMLVATGGPRLVAVILQGGKKAIGSSRGNPPTIVSEFADIERTSRDIVISCSLDNNIPCIAETSLIAPGSILKRVITVFQKLGAYLISGSNIDRLLNVIMAVQEEKIAEGCTDKPKRSYGKNKDYVAKDAKYLLSKIGIDVPDWVRNVACETPEDHPFVIEELHMPVLPVVQVKYIDEAIEVAVRVEHPHRFTAMMHSKHVDHLTRFARAVETTIFVKNAPSYAGIGVGGEGFTSFTLAGPTGEGITSPRSFTRQRRCVLVDAFSIV

SEQ ID NO: 246 - protein, 468 aa, Artificial Sequence
  Description of Artificial Sequence: Synthetic polypeptide
MNKDTLIPTTKLLKPKTNVENINLKNYKDNSSCKGVFENVEDALNSTVHARKILSGACGKEQREKFSTEIAKAALENKEVLATMILEETHRGRYEDKILKHELRATVTPGTENLTTTAWSGDNGLTINAMWAMGPAGASTPLTNPTETVICNSIGCIVGGNAVAFNPHPGAGKCVAYGIEMINMAIKGCGGPLNLVTTIMNPTLESLAAICKHPMIQLLCGTGGPRLVAVILQGGKKAIGSSRGNPPTIVDSFADIERTGKSIIISCSLDNNIPCIAETSLFVPENVLKDVISVFLKLNAVIINEDQVSLLIDLVLAKNNETQEYFKNKKWVAKDAKLFSDEIDVESPWNIKCVACEVNENHPFVMTELLMPILPIVRVKDIYEAVKYTKIAERPHKFSAMIYSKHIDNLWRFERGADSTIFVKNGLSLAGVGYEAPGFTSFTIAVPTGEGMTSAANFTRQRRTVNAN

SEQ ID NO: 247 - protein, 527 aa, Artificial Sequence
  Description of Artificial Sequence: Synthetic polypeptide
MNMTEKDIEKIVQSVLHNVESALGKSASASPSVSAVSVASGEGIKPVQFKQVPVFQQETVKSPNRNRNLGGAEEKWGVFNHMEDAIEASYRAQMEFVKHFQLKDREKIITAIREAVLREKEVLARKVYEETKRGRYEDKVAKHELRATVTPGTENLKTEAFSGDNGLTINARWAMGPAGASTPLTNPTETIINNAIGCLVGGNAVAFNPHPSSGRSCAYGVQLINMAIKGAGGPLHLVTMVMEPTRDTLATLCDSPMVQLLVGTGGPRIVAVILQGGKKAIGSSRGNPPTIVDSFADLERTSRSIISGAALDNNILCIAETSLFVPESVLKDVIFVFLNLGAYMLGQHEVELVMAFALAEQGNEQNRGCGFNPQRHYQKSKDWIAQDARLFLEHIGVQPPWEVKLNICDVEEDHPFVQLEQMMPVLPIVRVKTLDEAIEKAVMAEHGNRHTAIMHSKNVDHLTKFARAIQTTLFVKNASSLAGVGYGGEGHTTMTIAGPTGEGVTSAKTFTRERRCVLAEGGFRIIG

SEQ ID NO: 248 - protein, 434 aa, Fusobacterium sp.
MKNWKESYKAKICTPDEAIQKIKDAKRISFGHICSESTVLTEALLRNKKLFKKLEIAHLLSVGKSEYAKEENSEYFRHNALFIGPKTREAANSSYGDYTPTFFFETAKLFGKDGELSLDAMLLQVSPPDEHGYCSYGLSCDYTKSATESAKIVIAQINKFVPRTFGNCFVHIDDIDYIIEEDTPIPEVQPPVVGEIERKIGEFCASLINDGDTLQLGIGAIPVAVLNFLKDKKDLGIHSEMISDGIVDLINLGVITNKKKNLNPNKSIATFLMGSKKLYDYADNNPAIELHPVDYVNNPIIIAQNDNMISINSAIEVDLTGQVNAEYINSKEFSGPGGQVDFVRGATMSKGGKSIIALPSTAANGTISKIVFNFEEGVPVTTTRNDVDYVITEYGIAHLRGKTLRERAKLLIEIAHPNFREELRKKALEKFGKL

SEQ ID NO: 249 - protein, 434 aa, Fusobacterium sp.
MKNWKESYKAKICTPDEAIQKIKDAKRISFGHICSESTVLTEALLRNKKLFKKLEIAHLLSVGKSEYAKEENSEYFRHNALFIGPKTREAANSSYGDYTPTFFFETAKLFGKDGELSLDAMLLQVSPPDEHGYCSYGLSCDYTKSATESAKIVIAQINKFVPRTFGNCFVHIDDIDYIIEEDTPIPEVQPPVVGEIERKIGEFCASLINDGDTLQLGIGAIPVAVLNFLKDKKDLGIHSEMISDGIVDLINLGVITNKKKNLNPNKSIATFLMGSKKLYDYADNNPAIELHPVDYVNNPIIIAQNDNMVSINSAIEVDLTGQVNAEYINSKEFSGPGGQVDFVRGATMSKGGKSIIALPSTTANGTISKIVFNFEEGVPVTTTRNDVDYVITEYGIAHLRGKTLRERAKLLIEIAHPNFREELRKKALEKFGEL

SEQ ID NO: 250 - protein, 434 aa, Fusobacterium sp.
MKNWKESYKAKICTPDEAIQKIKDAKRISFGHICSESTVLTEALLRNKKLFKKLEIAHLLSVGKSEYAKEENSEYFRHNALFIGPKTREAANSSYGDYTPTFFFETAKLFGKDGELSLDAMLLQVSPPDEHGYCSYGLSCDYTKSATESAKIVIAQINKFVPRTFGNCFVHIDDIDYIIEEDTPIPEVQPPVVGEIERKIGEFCASLINDGDTLQLGIGAIPVAVLNFLKDKRDLGIHSEMISDGIVDLINLGVITNKKKNLNPNKSIATFLMGSKKLYDYADNNPAIELHPVDYVNNPIIIAQNDNMISINSAIEVDLTGQVNAEYINSKEFSGPGGQVDFVRGATMSKGGKSIIALPSTAANGTISKIVFNFEEGVPVTTTRNDVDYVITEYGIAHLRGKTLRERAKLLIEIAHPNFREELRKKALEKFGEL

SEQ ID NO: 251 - protein, 434 aa, Fusobacterium sp.
MKNWKKSYKAKICTPDEAIQKIKDAKRISFGHICSESTVLTEALLRNKKLFKKLEIAHLLSVGKSEYAKEENSEYFRHNALFIGPKTREAANSSYGDYTPTFFFETAKLFGKDGELSLDAMLLQVSPPDEHGYCSYGLSCDYTKSATESAKIVIAQINKFVPRTFGNCFVHIDDIDYIIEEDTPIPEVQPPVVGEIERKIGEFCASLINDGDTLQLGIGAIPVAVLNFLKDKRDLGIHSEMISDGIVDLINLGVITNKKKNLNPNKSIATFLMGSKKLYDYADNNPAIELHPVDYVNNPIIIAQNDNMISINSAIEVDLTGQVNAEYINSKEFSGPGGQVDFVRGATMSKGGKSIIALPSTAANGTISKIVFNFEEGVPVTTTRNDVDYVITEYGIAHLRGKTLRERAKLLIEIAHPNFREKLRKKALEKFGKL

SEQ ID NO: 252 - protein, 450 aa, Desulfomonile tiedjei
MNWKSYYNQRTFPAREAVKAIKSGDRVVHAHACGEPACLVNAMVDRADELRDVEIVHMVSMGKAKYCQPEYATSFRHNALFVGNTSRQAVNEGRGDYTCCYFSEIPLLFRNGLLPVDVALIAVSPPDKLGFVCLGISVDYTKQAALSAKTVIAAVNPNMPRIGGDSYLHVTDIDYFVPTEEPLIELQPPALGDLERAIGSNVASLIKDGDCLQLGIGALPDAVLSFLGEKTDLGIHSEMISDGVMKLVEAGVVTCKRKNFRPRKAVITFAMGTRGFYEWLNDNALMESYPVDFTNDPSIIAQNDNMVSINSAISVDLQGQVAADTLGSKQFSGVGGQVDFVRGANRSKGGRSIIAMPSTAAKGKASRIVAALDRGQAVTTPRNDVAYVVTENGVAALKGKTIRQRAEALIAIAAPEFQDRLREEFFEVYGLRGPTIQVSVQVAAGSAGAA

SEQ ID NO: 253 - protein, 428 aa, Porphyromonas uenonis
MSIPFSSITPDEAVSHIQDGDFVVLSHAAAVPQACVAALARNYERFHNVRIFHMVTLGESPYTAPEMEGHFRLVTNFVGANTRPAVDEQRADFVPSYFYEVPSMMQPGGAFHPDVAIVQLSYPNEEGYCSFGTSCDYTKPAAEQARVVIGELNKQMPFVGGDNLIHISQLTHIVEADYPLYALDLPRIGEVEEAIGRNCAELIQDGDTLQLGIGAIPDAVLLFLKDKKDLGIHSEMVSDGVVKLIKANTITGRRKTLHPNKVVATFLMGTQELYDFAHNNPTIEMRPVNYVNDPRIIAQNDQLVSINSCIEVDLMGQVVSEAMGLRQFSGPGGQVDFVRGAAWSKGGRSIIAIPSTARRGTASRIVPLLTEGAAITTSRNDVDYIVTEYGVAHLKGKSLRERALALTAIAHPNFRPELEAECKRRFKL

SEQ ID NO: 254 - protein, 431 aa, Pelosinus fermentans
MNNWRRVYQNKIVSAEQAVQHIKSQDRVVTGHACGEPQALIEALVARSPEIKDVEIVHMVAMGPAKYAQPGQEKSFRHNALFVGGTTRKAVEEKRADFTPCFFSEIPRLFKNNILPVDVALIQITPPDEQGFCSYGVSADYTKTAAECAKIVIAQVNHCLPRTGGASIHLDAVHFIVEQEEPLIELKPPKIGDIEKAIGEHVAALIPDGATLQLGIGAIPDAVLLFLTDKKDLGIHSEMFSDGVVVLAEAGVITNRKKTIHTGKFMATFLMGTKRLYDFVNNNPDVELQSVDYINDPYIIGQHENMISINSALQVNLMGEVNAEMIGPKQFSAVGGQVDFIRGASRSLQGKSIIALPSTASGGTISRIACELDRGAAVTTSRNDVHYVVTEYGMADLRGKCLGERAKSLIAISHPDFRSRLTKEAQEKGLM

SEQ ID NO: 255 - protein, 432 aa, Megasphaera sp.
MQDWKEKYAGKIVSPAEAVSHVKSGDKIVFSHACGESQVLTEALVKQADRLKDVEIIHMVAMGAAKYCLPEMEGHFRHNALFVGATTREAVESGRADYTPCFFHEAPRLFTDGTIPVDVVMLQVSEPDENGICSLGISVDYTQAAASVATLKIAQINKNMPYTYGNGIHLDDLDYLVIKDEPIIELPPPKIGEIEQRIGEHVASLIQDGDTLQLGIGAIPDAVLSFLGDKKDLGIHSEMFSDGVVDLAEKGVITNRKKSLDPGKFLSCFLMGTKKLYNFIDHNPDVIIRPVDYTNDPFVISQIDNIISINSAMQVDLMGQVNAEMIGLRQFSGVGGQVDFVRGAARAKGGKAIIAMPSTTGKTKKISKIVPLLDRGAAVTTSRNDVDYIVTEFGIAALHGKTLRQRAKALIAIAHPDFRASLEEEFNARFGL

SEQ ID NO: 256 - protein, 431 aa, Pelosinus fermentans
MNNWRRVYQNKIVSAEQAVQHIKSQDRVVTGHACGEPQALIEALVARSPEINNVEIVHMVAMGPAKYAQPGQEKSFRHNALFVGGTTRKAVEEKRADFTPCFFSEIPRLFKNNILPVDVALIQITPPDEQGFCSYGVSADYTKTAAECAKIVIAQVNHCLPRTGGASIHLDAVHFIVEQEEPLIELKPPKIGDIEKAIGEHVAALIPDGATLQLGIGAIPDAVLLFLTDKKDLGIHSEMFSDGVVVLAEAGVITNRKKTIHTGKFMATFLMGTKRLYDFVNNNPDVELQSVDYINDPYIIGQHENMISINSALQVNLMGEVNAEMIGPKQFSAVGGQVDFIRGASRSLQGKSIIALPSTASGGTISRIACELDRGAAVTTSRNDVHYVVTEYGMADLRGKCLGERAKSLIAISHPDFRSRLTKEAQEKGLM

SEQ ID NO: 257 - protein, 434 aa, Fusobacterium periodonticum
MKNWQEKYKTKICSPDEAIQKIKSAKRISFGHICSESTVLTEALVRNKQLFKKLEIDHLLSIGKCEYAKEENSEYFHHNALFIGPKTREAANSFYGDYTPIFFYQTAKIFGKDGDLAPDAMLLQVSPPDENGYCSYGLSCDYTKSATESAKIVIAQINKFVPRTLGNCFVHLDDIDYIILEDTPIPEIPAPVIGELEEKIGANCASLINDGDTLQLGIGAIPFAVLNFLKQKKDLGIHSEMVSDGIVDLIQAGVITNKKKNFNPNKVIATFLLGTKKLYDYADNNPAIELHPVDYVNNPMIIAQNDNMISINSAIQVDLMGQVNAEYINTKQFSGPGGQVDFVRGATMSNGGKSIIALPSTTADEKISKIVFTFEEGVPITTTRNDVDYIITEYGIAHLKGKTLRERAKLLIEIAHPKFREDLRKKAIEKFKIL

SEQ ID NO: 258 - protein, 434 aa, Fusobacterium nucleatum
MKNWKESYKAKICTPDEAIQKIKDAKRISFGHICSESTVLTEALLRNKKLFKKLEIAHLLSVGKSEYAKEENSEYFRHNALFIGPKTREAANSSYGDYTPTFFFETAKLFGKDGELSLDAMLLQVSPPDEHGYCSYGLSCDYTKSATESAKIVIAQINKFVPRTFGNCFVHIDDIDYIIEEDTPIPEVQPPVVGEIERKIGEFCASLINDEDTLQLGIGAIPVAVLNFLKDKKDLGIHSEMISDGIVDLINLGVITNKKKNLNPNKSIATFLMGSKKLYNYADNNPAIELHPVDYVNNPIIIAQNDNMISINSAIEVDLTGQVNAEYINSKEFSGPGGQVDFVRGATMSKGGKSIIALPSTAANGTISKIVFNFEEGVPVTTTRNDVDYVITEYGIAHLRGKTLRERAKLLIEIAHPNFREELREKALEKFGTL

SEQ ID NO: 259 - protein, 434 aa, Fusobacterium sp.
MKNWKESYKTKICTPDEAIQKIKDAKRISFGHICSESTVLTEALIRNKKLFKKLEIAHLLSVGKSEYAKEENSEYFRHNALFIGPNTREAANSSYGDYTPTFFFETAKLFGKAGELSLDAMLLQVSPPDEHGYCSYGLSCDYTKSATENAKIVIAQINKFVPKTFGNCFVHIDDIDYIIEEDTPIPEVQPLVVGEIERKIGEFCASLINDGDTLQLGIGAIPVAVLNFLKDKKDLGIHSEMISDGIVDLINLGVITNKKKNLNPNKTIATFLMGSKKLYDYANDNPAIELHPVDYVNNPIIIAQNDNMISINSAIEVDLTGQVNAEYINSKEFSGPGGQVDFVRGSTMSKGGKSIIALPSTAANGTISKIVFNFEEGVPVTTTRNDVDYIITEYGIAHLRGKTLRERARLLIEIAHPNFREELRKKALEKFGKL

SEQ ID NO: 260 - protein, 434 aa, Fusobacterium sp.
MEKWQKKYKAKICSPDEAIQKIKSAKRISFGHICSESSVLTEALIRNKKLFKKLEIDHLLSIGKCEYAKEENSEYFHHNALFIGPKTREAANSSYGDYTPIFFYETAKIFGKDGDLSPDAMLLQVSTPDEHGYCSYGLSCDHTKSATESAKIVVAQINKFVPRTLGNCFIHIDDIDYIILEDTPIPEIPAPVVGELEEKIGANCASLINDGDTLQLGIGAIPFAVLNFLKDKKDLGIHSEMISDGIVDLIQAGVITNKKKNFNPNKVIATFLLGTKKLYDYANNNPAIELHPVDYVNNPMIIAQNNNMISINSAIQVDLMGQVNAEYINTKQFSGPGGQVDFVRGATMSNGGKSIIALPSTTADEKISRIVFTFEEGVPVTTSRNDVDYIITEYGIAHLKGKTLRERAKLLIEIAHPKFREELRKRAIEKFEIL

SEQ ID NO: 261 - protein, 434 aa, Fusobacterium nucleatum
MKKWKESYKLKICTPDEAIQKIKDAKRISFGHICSESSVLTEALVRNKKLFKKLEIAHLLSVGKSEYAKEENSEYFRHNALFIGSKTREAANSSYGDYTPTFFFETAKLFGKDGELALDAMLLQVSTPDEHGYCSYGLSCDYTKSATENAKIVIAQINKFVPRTLGNCFVHIDDIDYIIEEDTPIPEVQPPVVGEIERKIGGFCASLVRDGDTLQLGIGAIPVAVLNFLKEKKDLGIHSEMISDGIVDLINLGVITNKKKNLNPNKAIATFLMGSKKLYDYANDNPAIELHPVDYVNNPIIIAQNDNMVSINSAIQVDLMGQVNAEYIDSKQFSGPGGQVDFVRGATMSKGGKSIIALPSTTAKESISRIVFAFDEGTPVTTSRNDVDYVITEYGIAHLRGKTLRERAKLLIEIAHPKFREELRKKALEKFGEL

SEQ ID NO: 262 - protein, 434 aa, Fusobacterium sp.
MEKWQEKYKAKICSPDEAIQKIKSAKRISFGHICSESSVLTEALIRNKKLFKKLEIDHLLSIGKCEYAKEENSEYFHHNALFIGSKTREAANSSYGDYTPIFFYETAKIFGKDGDLSPDAMLLQVSTPDEHGYCSYGLSCDYTKSATESAKIVVAQINKFVPRTLGNCFIHIDDIDYIILEDTPIPEIPTPVVGELEEKIGANCASLINDGDTLQLGIGAIPFAVLNFLKDKKDLGIHSEMVSDGIVDLIQAGIITNKRKNFNPNKVIATFLLGTKKLYDYANNNPAIELHPVDYVNNPMIIAQNNNMISINSAIQVDLMGQVNAEYINSKQFSGPGGQVDFVRGATMSNGGKSIIALPSTTADEKISRIVFTFEEGVPVTTSRNDVDYIITEYGIAHLKGKTLRERARLLIEIAHPKFREELRRKAIEKFEIL

SEQ ID NO: 263 - protein, 434 aa, Fusobacterium nucleatum
MKNWKESYKTKICTPDEAIQKIKDAKRISFGHICSESTVLTEALIRNKKLFKKLEIAHLLSVGKSEYAKEENSKYFRHNALFIGPKTREAANSSYGDYTPTFFFETAKLFGKDGELALDAMLLQVSTPDEHGYCSYGLSCDYTKSATENAKIVIAQINKFVPRTFGNCFVHIDDIDYIIEEDTPILEVQPPVVGETERKIGEFCASLVRDGDTLQLGIGAIPVAVLNFLKDKKDLGIHSEMISDGIVDLINLGVITNKKKNLNPNKAIATFLMGSKKLYDYADNNPAIELHPVDYVNNPIIIAQNDNMVSINSAIQIDLMGQVNAEYVDSKQFSGPGGQVDFVRGTTMSKGGKSIIALPSTTAKGTISRIVFTFDEGVPVTTSRNDVDYVITEYGIAHLRGKTLRERAKLLIEIAHPNFREELRKKALEKFGEL

SEQ ID NO: 264 - protein, 434 aa, Fusobacterium nucleatum
MKNWKESYKAKICTPDEAIQKIKDAKRISFGHICSESTVLTEALLRNKKLFKKLEIAHLLSVGKSEYAKEENSEYFRHNALFIGPKTREAANSSYGDYTPTFFFETAKLFGKDGELSLDAMLLQVSPPDEHGYCSYGLSCDYTKSATESAKIVIAQINKFVPRTFGNCFVHIDDIDYIIEEDTPIPEVQPPVVGEIERKIGEFCASLINDGDTLQLGIGAIPVAVLNFLKDKRDLGIHSEMISDGIVDLINLGVITNKKKNLNPNKSIATFLMGSKKLYDYADNNPAIELHPVDYVNNPIIIAQNDNMISINSAIEVDLTGQVNAEYINSKEFSGPGGQVDFVRGATMSKGGKSIIALPSTAANGTISKIVFNFEEGVPVTTTRNDVDYVITEYGIAHLRGKTLRERAKLLIEIAYPNFREELRKKALEKFGEL

SEQ ID NO: 265 - protein, 434 aa, Fusobacterium nucleatum
MKNWKESYKSKIGTPDEAIQKIKDAKRISFGHICSESTVLTEALVRNKKLFKKLEIAHLLSVGKSEYAKEENSEYFRHNALFIGPKTREAANSSYGDYTPTFFFETAKLFGKDGELALDAMLLQVSTPDEHGYCSYGLSCDYTKSATENAKIVIAQINKFVPRTLGNCFVHIDDIDYIIEEDTPIPEVQPPVVGEIERKIGEFCASLVRDGDTLQLGIGAIPVAVLNFLKDKKDLGIHSEMISDGIVDLINLGVITNKKKNLNPNKAIATFLMGSKKLYDYANDNPAIELHPVDYVNNPIIIAQNDNMVSINSAIQVDLMGQVNAEYVDSKQFSGPGGQVDFVRGATMSKGGKSIIALPSTTGKGTISRIVFTFDEGVPVTTSRNDVDYVITEYGIAHLRGKTLRERAKLLIEIAHPDFREELRKKALEKFGEL

SEQ ID NO: 266 - protein, 431 aa, Roseiflexus sp.
MPRTLTTGTREMTAEEAVELIESNHRVYIGGGCGVPLPLLQALVARASELRNVEIIHMLTAGEDPTTAPDLAASFRHNALFIGHNTRRAVNEGRADFTPIFLSEIPKLFRKGILPLDVAMIQVSPPDRHGFCSLGVEVGCTLPAARTARIVIAEVNARMPRTLGDSFIHVSRLTAMVESDRPLLELPQGETNGVAQAIGRHIAELIPDGATLQLGIGAIPDAVLSNLRGKRHLGIHTELFSDGVIDLVESGVIDGELKTIHQGKVVAGFILGSQRCFDWAHNNAMVEMHPTDYVNDPFVIAQHKNMVAVNSALQVDLTGQVCADSIGTRLYSGVGGQLDFIRGASRSEGGIPIIAISSTARDGTISRIVPTLDPGAGVVTTRYDVHFVVTEYGVADLYGRTLAQRARALINVAHPAFRDQLTEAAKKLHYI

SEQ ID NO: 267 - protein, 428 aa, Porphyromonas asaccharolytica
MSIPFSSISPDEAVSHIQDGDFVVLSHAAAVPQACVAALARNYERFHDVRIFHMVTLGESPYTAPEMEGHFRLVTNFVGANTRPAVDEQRADFVPSYFYEVPSMMQPGGVFHPDVAIVQLSYPNEEGYCSFGTSCDYSKPAAEQARVVIGELNKQMPFVGGDNLIHISQLTHIVEADYPLYALDLPRIGEVEEAIGRNCAELIQDGDTLQLGIGAIPDAVLLFLKDKKDLGIHSEMVSDGVVKLIKAHTITGRCKTLLPNKVVATFLMGTQELYDFAHNNPAIEMRPVNYVNDPRIIAQNDHLVSINSCIEVDLMGQVVSEAMGLRQFSGPGGQVDFVRGAAWSKGGRSIIAIPSTARRGTASRIVPLLTEGAAITTSRNDVDYIVTEYGVAHLKGKSLRERALALTAIAHPNFRPELEAECKRRFKL

SEQ ID NO: 268 - protein, 434 aa, Fusobacterium nucleatum
MKNWKESYKTKICTPDEAIQKIKDAKRISFGHICSESTVLTEALIRNKKLFKKLEIAHLLSVGKSEYAKEENSEYFRHNALFIGPNTRETANSSYGDYTPTFFFETAKLFGKDGELALDAMLLQVSTPDEHGYCSYGLSCDYTKSATENAKIVIAQINKFVPRTLGNCFVHIDDIDYIIEEDTPIPEVQPPVVGETERKIGEFCASLVRDGDTLQLGIGAIPVAVLNFLKDKKDLGIHSEMISDGIVDLINLGVITNKKKNLNPNKAIATFLMGSKKLYDYADNNPAIELHPVDYVNNPIIIAQNDNMVSINSAIQIDLMGQVNAEYVDSKQFSGPGGQVDFVRGATMSKGGKSIIALPSTTAKGTISRIVFTFDEGVPVTTSRNDVDYVITEYGIAHLRGKTLRERAKLLIEIAHPNFREELRKKALEKFGEL

SEQ ID NO: 269 - protein, 445 aa, Geobacter bemidjiensis
MAATIWKEIKNWREIYNSRVTTADEALKSVNSGDRLYLTGNASVPLQLLDALVRRAPELRDVEVSQVLTICPQDYVSPEMQGHVRVNTMFISPNVRQAVNEGRADFTPVLLSEFPLLFKNGHLPLDVALLNVSLPDENGFCSLGGEAGLTMTAAESARIVIAQVNKKMPRTLGDTFFHVSRMTHIVEVDAPLTERHMAEEGDPEIVEQIAGHISSLIPDGATMQLGIGAIPDAVLKHLFSKKDLGIHSELISDGVIDLVEAGVVNCSRKTLHPGKIVCGFLLGTKRLYDWAHNNPMIELRRTEYVNDPFVVAQNDRMVSVNAAIEVDFTGQICADSIGPRMYSAVGGQMDFVYGASRSKGGVAVITMPSTSTLRDGSVVSKITPLLKHGAGVVTSRNHVRYLVTEYGAADLYAKSVRQRTQALIGVAHPMFREELTEKAKELRYI

SEQ ID NO: 270 - protein, 434 aa, Fusobacterium sp.
MKNWKESYKTKICTPDEAIQKIKDAKRISFGHICSESTVLTEALIRNKKLFKKLEIAHLLSVGKSEYAKEENSEYFRHNALFIGPNTREAANSSYGDYTPTFFFETAKLFGKDGELALDAMLLQVSTPDEHGYCSYGLSCDYTKSATENAKIVIAQINKFVPRTLGNCFVHIDDIDYIIEEDTPIPEVQPPVVGETERKIGEFCASLVRDGDTLQLGIGAIPVAVLNFLKDKKDLGIHSEMISDGIVDLINLGVITNKKKNLNPNKAIATFLMGSKKLYDYADNNPAIELHPVDYVNNPIIIAQNDNMVSINSAIQIDLMGQVNAEYVDSKQFSGPGGQVDFVRGATMSKGGKSIIALPSTTAKGTISRIVFTFDEGVPVTTSRNDVDYVITEYGIAHLRGKTLRERAKLLIEIAHPNFREELRKKALEKFGEL

SEQ ID NO: 271 - protein, 434 aa, Fusobacterium sp.
MKNWKESYKTKICTPDEAIQKIKDAKRISFGHICSESTVLTEALIRNKKLFKKLEIAHLLSVGKSEYAKEENSEYFRHNALFIGPNTREAANSSYGDYTPTFFFETAKLFGKDGELALDAMLLQVSTPDEHGYCSYGLSCDYTKSATENAKIVIAQINKFVPRTLGNCFVHIDDIDYIIEEDTPIPEVQPPVVGETERKIGEFCASLVRDGDTLQLGIGAIPVAVLNFLKDKKDLGIHSEMISDGIVDLINLGVITNKKKNLNPNKAIATFLMGSKKLYDYADNNPAIELHPVDYVNNPIIIAQNDNMISINSAIQIDLMGQVNAEYVDSKQFSGPGGQVDFVRGATMSKGGKSIIALPSTTAKGTISRIVFTFDEGVPVTTSRNDVDYVITEYGIAHLRGKTLRERAKLLIEIAHPNFREELRKKALEKFGEL

SEQ ID NO: 272 - protein, 435 aa, Eubacterium yurii
MDVKKVYEEKKMTAQEAVKKIKSGDRVIVGHACGEPACLLNAMVDNKDDYENVEIVHMVAMGKARYCEEGMEKHFRHNALFVGGTTKKAVNEARADFTPTFFFEVPKLFREKLPVDVVLAQVSPMDDDGYMSLGISVDYTKPACEIAKTVILQVNKNMPRTMGDSLIHISNATCIVECDETIYTLPRPAIGELEKKIGENCAKLIRDGDTLQLGIGAIPDAVLSFLTDKKDLGIHSEMFTDGVVELVKKGVVTNKMKKTHTGKMIATFLMGTRELYDFVDNNHDIAMFPVDYVNHPAIIMKEDNMVSINSCVQVDLMGQVVSESIGKTQISGVGGQVDFVRGASMAKNGRSIIAMPSTVKDKSSKIVVKIDDYAAVTTSRNDVDYVVTEYGIAELKGKTLKQRSENLIKIAHPKFREELIKYHNEKFNDNLKLEN

SEQ ID NO: 273 - protein, 431 aa, Roseiflexus castenholzii; identical to SEQ ID NO: 189

SEQ ID NO: 274 - protein, 434 aa, Fusobacterium nucleatum
MKNWKESYKSKICTPDEAIQKIKGAKRISFGHICSESTVLTEALVRNKKLFKKLEIAHLLSVGKSEYAKEENSEYFRHNALFIGPKTREAANSSYGDYTPTFFFETAKLFQKDEELALDAMLLQVSTPDEHGYCSYGLSCDYTKSATENAKIVIAQINKFVPRTLGNCFVHIDNIDYIIEEDTPIPEVQPPVVGEIERKIGGFCASLVRDGDTLQLGIGAIPVAVLNFLKDKKDLGIHSEMISDGIVDLINLGVITNKKKNLNPNKAIATFLMGSKKLYDYANDNPAIELHPVDYVNNPIIIAQNDNMVSINSAIQVDLMGQVNAEYIDSKQFSGPGGQVDFVRGATMSSGGKSIIALPSTTGKGTISRIVFTFDEGVPVTTSRNDVDYVITEYGIAHLRGKTLRERAKLLIEIAHPDFREELRKKALEKFGEL

SEQ ID NO: 275 - protein, 428 aa, Porphyromonas asaccharolytica
MSIPFSSISPDEAVSHIQDGDFVVLSHAAAVPQACVAALARNYERFHDVRIFHMVTLGESPYTAPEMEGHFRLVTNFVGANTRPAVDEQRADFVPSYFYEVPSMMQPGGVFHPDVAIVQLSYPNEEGYCSFGTSCDYSKPAAEQARVVIGELNKQMPFVGGDNLIHISQLTHIVEADYPLYALDLPRIGEVEEAIGRNCAELIQDGDTLQLGIGAIPDAVLLFLKDKKDLGIHSEMVSDGVVKLIKAHTITGQCKTLLPNKVVATFLMGTQELYDFAHNNPAIEMRPVNYVNDPRIIAQNDHLVSINSCIEVDLMGQVVSEAMGLRQFSGPGGQVDFVRGAAWSKGGRSIIAIPSTARRGTASRIVPLLTEGAAITTSRNDVDYIVTEYGVAHLKGKSLRERALALTAIAHPNFRPELEAECKRRFKL

SEQ ID NO: 276 - protein, 425 aa, Imtechella halotolerans
MHQFVSADQAVKAIKSGDRIYVQAAAAAPSVLIEALTKRASELQNVEICHLHTEGPAPYADPSLRDSFHVNSFFIGKNVRHTLKAGNGSYTPVFLSELPNVFRRGIVTLDVAFVHVSPPDSHGYCSLGVSVEASIAAIESAKIVIAQVNNQMPRTFGDGIIHVSEINYLVEANVPIFEHGMAEATEVELQIGRNIATLIEDGATLQMGIGSIPNAALLQLTNHKNLGLHTEMFSDGVIELIEKNVINCNYKVVNRGRALATFLLGSKRLYDFVNDNPFIEMRESSYVNDTAVIRQNPKTIAINSAIEVDLTGQVCADSIGSTMYSGVGGQMDFIRGASLSPGGKAIIALPSVTRRGESRIVSYLKTGAGVVTTRSHVQYIITEYGIAELYGKSLQQRAKALINIAHPAHREQLDKDFFSVQRSYV

SEQ ID NO: 277 - protein, 434 aa, Fusobacterium nucleatum
MKNWKESYKSKICTPDEAIQKIKDAKRISFGHICSESTVLTEALVRNKKLFKKLEIAHLLSVGKSEYAKEENSEYFRHNALFIGPKTREAANSSYGDYTPTFFFETAKLFGKDGELALDAMLLQVSTPDEHGYCSYGLSCDYTKSATENAKIVIAQINKFVPRTLGNCFVHIDDIDYIIEEDTPIPEVQPPVVGEIERKIGEFCASLVRDGDTLQLGIGAIPVAVLNFLKDKKDLGIHSEMISDGIVDLINLGVITNKKKNLNPNKAIATFLMGSKKLYDYANDNPAIELHPVDYVNNPIIIAQNDNMVSINSAIQVDLMGQVNAEYIDSKQFSGPGGQVDFVRGATMSKGGKSIIALPSTTGKGTISRIVFTFDEGTPVTTSRNDVDYVITEYGIAHLRGKTLRERAKLLIEIAHPDFREELRKKALEKFGEL

SEQ ID NO: 278 - protein, 435 aa, Eubacterium sp.
MDVKKLYEEKKMTAQEAVKKIKSGDRVIVGHACGEPACLLNAMVDNKDDYENVEIVHMVAMGKARYCEEGMEKHFRHNALFVGGTTKKAVNEARADFTPTFFFEVPKLFREKLPVDVVLAQVSPMDDDGYMSLGISVDYTKPACEIAKTVILQVNKNMPRTMGDSLIHISNATCIVECDETIYTLPRPEIGELEKKIGENCAKLISDGDTLQLGIGAIPDAVLSFLTDKKDLGIHSEMFTDGVVELVKKGVVTNKMKKTHTGKMIATFLMGTRELYDFVDNNHDIAMFPVDYVNHPAIIMKEDNMVSINSCVQVDLMGQVVSESIGKTQISGVGGQVDFVRGASMAKNGRSIIAMPSTVKDKSSKIVVKIDDYAAVTTSRNDVDYVVTEYGIAELKGKTLKQRSENLIKIAHPKFREELIKYHNEKFNDNLKLEN

SEQ ID NO: 279 - protein, 434 aa, Desulfosporosinus acidiphilus
MDWRETYKSRLTTADEAVKVVKSGDFVIPGHAASESELLVNALVKRYLDLENVTIIQGVALGSSPYCKPEMEGHFILKSMFVGANTRKSVWENRGTFFPLMFHEFPRAFREGYLGSDVFITMVSPPDEHGYCSLGMSVDHSKELVRCAKTVIAEVNPNVPRTYGDTFVHVSDLDYIVENDGPLLELNRFAAMDEVTQAIGRNVAGLINDGDTLQMGAGTIPDAILHYLKDKRDLGIHTEMFSDGLIDLIEAGIVNCSKKTINPGKIVVTFAEGTKKVYEYIDRNPMFQFHPVDYVNNPCIIAQHDNMVAINSALEIDLSGQVCAEALGAKQYSGIGGQLDFIRGAAAAKNGRPVIVLQSTAKSATISRISCQLKPGTPVTTTRNDVHWVATEYGAVDLFCKSEKERAAALISIAHPNFRDELKRQYREIYGRVL

SEQ ID NO: 280 - protein, 431 aa, Flavonifractor plautii
MNWKEYYKQHLMSAEDAVNHIQSGNRVVVAHACGEPSYLLDVMVANAKAYRDVEIVHMVAMGKAEYCKPEYAGNFRHNAFFVGGTSRDAIAEGRGDFTPSFFFEVPRQFSSTMPVDVAMVMVTPPDENGMCSLGVSVDYTLEAVKQAKLVIAQVNPQMPWTGPYSLVSVKDLDCIVEHEAPIIELKPPKIGDIEKAIGEHCASLVPDGATLQLGIGAIPDAVLLFLKHKKDLGIHSEMFSDGVVELAEAGVITNAKKTLHPGKFEVAFLMGTRRLYDFVDHNPDVELRPVDYVNNPFVIAQNENMVSINSCVQVDLMGQVASESIGPKQISGVGGQVDFVRGASASKGGVSIMAMPSTVKGKISKIVPLLDEGAAVTTSRNDVDYIVTEYGVAALKGQTLRQRARNLIEIAHPDFRDELKAEYEKRFHCKY

SEQ ID NO: 281 - protein, 430 aa, Clostridium arbusti
MNWKDIYKDRLVSAKEAVSNIKSGSRVVIGHAVGEPLALVDALVENKKYYDNLEIVHMVAMGKSEYVKPGMEKYFRHNALFVGNSTREAVNSGRADYTPGFFYEVPRLFKEGYLPVDVALIQVSVPDKHGYCSFGVSNDYTKPAADNAKLVIAEVNENMPRTLGDSFIHVSDIDYIVEASHPLIELQPSKIGDVEKAIGKYCASLIEDGSTLQLGIGAIPDAVLLFLKDKKDLGIHSEMISDGVVELVNDGVITNKKKAFHNGKIVVTFLMGTKKLYDFVNDNPMVESYPVSFVNDPETIMKNNDMISINSCIQVDLMGQICSESIGIKQISGVGGQVDFIRGTSMAKNGKAIIAMPSTAAKGKVSRIVPILDEGAAVTTSRNDVDYIITEYGIAHLKGKTLRDRAKDLIDIAHPDFREYLSEELKKRFR

SEQ ID NO: 282 - protein, 433 aa, Clostridium carboxidivorans; identical to SEQ ID NO: 198

SEQ ID NO: 283 - protein, 430 aa, Tannerella forsythia
MEWKTTYRNKIVSADEAVRQIRNNELVSLGHAAGVPQMCVDALVRNSTYFKNVGIYHMLVLGEAKYTEPGMEEAFRHVASFIGANTRSAIKEKRVDFLPAFLSEVPRMIRERLIPVDVAIVQLSPPDEDGNCSFGISSDYSKPSTEHARLVIGEINEQMPYIGGDNLIHLSKLDCIVEADYPLYTIAPPRITEVEEAIGRNCATLIEDGATLQLGIGAIPDAVLLFLKDKKNLGIHSEMFSDGVLELVKNGVINGKAKTLHPNKMVATFLMGTQALYDFVNHNPDVEMYPSDYVNDPRVIAQNDRMISINSCLSVDLAGQVSSESIGLQQISGTGGQVDYVRGSMWSRGGKSIMAMPSTAKNGTTSRIVATLTEGTTVTTSRNDVDYVVTEYGVARLRGKSLRERAKALIKIAHPDFREELEAFYQQRFH

SEQ ID NO: 284 - protein, 442 aa, Anaerostipes sp.
MRDKKDKPWKAEYREKLVSADEAVSHIRSGQRIVFSHAAGESLVLSDALVRNRALFENVEIVHMVAMGEAKYCEPGMEKHFRHNSFFLGASTRKAAKEGRADVTPVYFSEVPELFRTTLPVDAVFLNLSPPDEHGYCSFGISVDYSKPAAMEAELVIAQINPSMPRTLGDSFIHISDIDYIVEADTPLIELPPAGISEVERAIGKNCASLIEDGDTLQLGIGAIPDAVLGFLKEKKDLGIHSEMISDGIVELYEGGVITNRRKSLHAGKSIVTFLMGTRRLYDFADNNPAVELHPVDYVNDPYVIAQNERLVSVNSCVQVDLMGQVFSASVGRRQISGVGGQVDFVRGANMSRGGKSIMAMPSTAAEGRISKIVPVIGEGAAVTTSRYDADYIVTEYGAARLKGESLRNRAKKLIRIAHPDFRRMLAEEYEKRFREAWSDDE

SEQ ID NO: 285 - protein, 435 aa, Fusobacterium sp.
MENWKEIYKEKIVTADEAVKYIQSGNRVIFAHACGEAQIITEAMLRNKEEYEKVEIVHLVPMGTGEYAQEENQKYFYHNSFFGGGSTRKALNGTYGDFTPSFFFEIPKLFKKDGKLPVDVAIIQVSSPDEHGYCSYGISCDYTKGAAENAKIVIAQVNKYMPRTLGDSFIHLSEMDYIVAYDEPILQLVPPKIGEIEQKIGEYCASLIQDGDTLQLGIGAIPDAVLTFLKDKRHLGIHSEMISDGVVDLILAGVIDNSKKTIHKNKCVVSFLMGSPKLYDFVNNNPAVELYPVDYVNHPMIIAKNDNMISINSALQVDLMGQVNAESIGAKQFSGTGGQVDFVRGASMSKGGKSIIAMPSTAAKGRISKIVMNLDLGSTVTTSRNDVDYVVTEYGIASLKGKTLRERAKALIAIAHPDFRESLMKQALEKFQILN

SEQ ID NO: 286 - protein, 445 aa, Geobacter sp.
MAATIWKEIKNWREIYNSRVTTADEALKSVNSGDRLYLTGNASVPMQLLEALVKRAPELRDVEVSQVLTICPQDYVSPEMEGHVRVNTMFISPNVRQAVNEGRADFTPVLLSEFPLLFKHGHLPLDVALLNVSLPDENGFCSLGGEAGLTMTAAESARIVIAQVNKKMPRTLGDTFFHVSRMTHIVEVDAPLTERHMAEEGDPQIVEQIAGHISSLIPDGATMQLGIGAIPDAVLKHLFSKKDLGIHSELISDGVIDLVEAGVVNCSRKTLHPGKIVCGFLLGTKRLYDWAHNNPMIELRRTEYVNDPFVVAQNDRMVSVNAAIEVDFTGQICADSIGPRMYSAVGGQMDFVYGASRSKGGVAVITMPSTSTMRDGSVVSKITPLLKHGAGVVTSRNHVRYLVTEYGAADLYAKSVRQRTQALIGVAHPMFRDELTEKAKELRYI

SEQ ID NO: 287 - protein, 432 aa, Desulfosporosinus acidiphilus
MKWQTVYDGRIKEAAEAVRIIKSGQRVVIGHACGEPQALVEAMAERKSELQSVEIVHMVAMGKASYCLPEMEGHFRHNSLFVGGTSRKAVNEGRADFTPVFFSEIPSLFRDGYLPPDVALVQMSPPDQSGFCSLGVSVDYTLQALRSAHTVIAQVNHFMPRTLGDSFVHVSELDIIVPFDEPLIELPKPQISQVEENIGRFVAGLVPDGATLQLGIGAIPDAVLRFLTNKNDLGIHSEMFSDGVVNLYEMGVINNKAKTLHPGKMLATFLMGTRVLYDFVNDNPVVEMHSVDYTNNPYIIGRNERLTSINSALQVDLCGQVCADSIGYRQYSAVGGQVDFVRGARLSCGGKSIIALPSTAANGKISRIAIHLDEGAAVTTSRNDVDYIVTEYGIASLRGKTIRERANALIEIAHPQFHEELKVQAKKNGIPL

SEQ ID NO: 288 - protein, 429 aa, Clostridium kluyveri
MEWEEIYKEKLVTAEKAVSKIENHSRVVFAHAVGEPVDLVNALVKNKDNYIGLEIVHMVAMGKGEYTKEGMQRHFRHNALFVGGCTRDAVNSGRADYTPCFFYEVPSLFKEKRLPVDVALIQVSEPDKYGYCSFGVSNDYTKPAAESAKLVIAEVNKNMPRTLGDSFIHVSDIDYIVEASHPLLELQPPKLGDVEKAIGENCASLIEDGATLQLGIGAIPDAVLLFLKNKKNLGIHSEMISDGVMELVKAGVINNKKKTLHPGKIVVTFLMGTKKLYDFVNNNPMVETYSVDYVNNPLVIMKNDNMVSINSCVQVDLMGQVCSESIGLKQISGVGGQVDFIRGANLSKGGKAIIAIPSTAGKGKVSRITPLLDTGAAVTTSRNEVDYVVTEYGVAHLKGKTLRNRARALINIAHPKFRESLMNEFKKRF

SEQ ID NO: 289 - protein, 432 aa, Thermoanaerobacter siderophilus
MNWHDEYIRKVVSPDEAVKHIKSGDRVVIQHACGEPQLLVDAMVKNADMYENVEIVHMVAMGKAEYTKPGMEKHFWHNSLFLGATTREAINEGRGDYTPCFFFEIPNLFRNNILPVDVALIQVSKPDRHGYCSLGVSCDYTKAAVECAKIVIAEVNEKMPRTGGDCFVHVSDIDYIVEASEPIIELKRAKIGDVEKKIGENCAKLIEDGSTLQLGIGGIPDAVLSFLKDKNDLGIHSEMFSDGVVELVENGNITNKAKTLHKGKFIATFLMGSQKLYDFVNDNPAVGLYPVDYVNNPYIIAQNHRMVSINSAIQIDLMGQVAAESIGIKQFSGTGGQVDFVRGAALAKDGKAIIAMPSTAAGGKVSRIVPYLDEGAAVTTSRNDVQYVVTEYGIADLRGKTLRERARELINIAHPKFRDFLLEKAKERFKNF

SEQ ID NO: 290 - protein, 434 aa, Fusobacterium gonidiaformans
MTHWKGLYQERLCSAEQAVKSIPNNCRVVPSHAAGEPKHLVEAMMANREQYHNVDIFSMVNLGHAAYGKEEEKEHFHVNAAYASASTREVVNAEHGDFTPCFFYQVPELLKKDGPMPADVALIQVSLPDEHGYCSLGVSSDYTKEAAENAKIVIAQVNKYMPRTLGNNFVHVSKMTHIVEYDEPIHILNPPFVGETERKIGEYCASLIQDGDTLQLGIGAIPDAVLSFLTDKKHLGIHSEMISDGVVDLIEAGVIDNSRKNFNPGKSIVSFLMGTEKLYNYVHNNPALEMHPVDYVNHPIIAAQNDNLVSINSALQVDLMGQANSETLGHKQFTGIGGQVDFVRAASMSKGGRTIIAMPSTAAKGKISKIVFLLDEGAAVTTSRTDIDYVITEYGIAKLRGKSLRARAKALIEIAHPDFREGLREQALQKFGRL

SEQ ID NO: 291 - protein, 433 aa, Fusobacterium varium
MDWKEEYKKRVYSPEEAVKKIKSNNRVVICHAAGEPQTLVDAMVKNYKEYENVEIVHMVPLGKCEYMKPEMAGHFRHNGLFLGGGTREAVSAGAGEYTPSFFFEIPKLFRKGGNLPVDVALIQVSLPDEHGYCSLGITCDYTKAAAENAKCVIAQVNKFMPRVLGDNFIHISEIDAIVEKDEPIIVLNPPKIGDVERKIGEYCASLINDGDTLQLGIGGIPDAVLTFLKDKKDLGIHSEMISDGVVDLVKAGVINNSKKTLHRGKSIVSFLMGTRKLYDYVDDNPSVEIYPVDYVNDPRVISKNDNIVSINSAIQVDLMGQVNAETIGTKQFSGTGGQVDFVRGTAFALNGKSIIAIPSTASKGKVSRITAYLDEGAAVTTSRNDVQYIITEYGIADLRGKTLRERAKELIKIAHPDFREELTQKALEKYKTL

SEQ ID NO: 292 - protein, 436 aa, Fusobacterium necrophorum; identical to SEQ ID NO: 191

SEQ ID NO: 293 - protein, 443 aa, Anaerostipes caccae
MMRDKKDKPWKAEYREKLVSADEAVSHIRSGQRIVFSHAAGESLVLSDALVRNRALFENVEIVHMVAMGAAKYCEPGMEKHFRHNSFFLGASTRKAAKEGRADVTPVYFSEVPELFRTTLPVDAVFLNLSPPDEHGYCSFGISVDYSKPAAMEAELVIAQINPSMPRTLGDSFIHISDIDYIVEADTPLIELPPAGISEVERAIGKNCASLIEDGDTLQLGIGAIPDAVLGFLKEKKDLGIHSEMISDGIVELYEAGVITNRRKSLHAGKSIVTFLMGTRKLYDFADNNPAVELHPVDYVNDPYVIAQNERLVSVNSCVQVDLMGQVVSASVGRRQISGVGGQVDFVRGANMSRGGKSIMAMPSTAAEGRISKIVPVIGEGAAVTTSRYDADYIVTEYGTARLKGETLRNRARKLIRIAHPDFRRMLAEEYEKRFREAWSDDE

SEQ ID NO: 294 - protein, 432 aa, Clostridium sp.
MDWKDLYAQRKMTAEEAVARVRSGDRVVTPNAAGAPVHLINALVARKDDLKNVEIAHMVPLAKAPYAAPEMEGHFIHNSIFVGGSTRATIEAGIGDYTPCFFHKVPELFDTTLPVDVALIHVSAPDEHGYCSYGVTVDYEKHAAEVAKLVIAQVNENMPRTLGDCFIHVSEIDCIVECNDPILELGAPKITEIEKKIGGHCAELIKDGDTLQLGIGAIPDAVLLFLKEKKDLGIHTEMFSDGVVELVEAGVINNSKKTLHKGKSVATFLMGTRRLYDYVHNNPAVEMYPVNYVNDPVVIAKNDNLVSINSCVQIDLLGQVVSESIGPVQISGVGGQIDFIRGASMSRGGRSILAMNSTAAGGKVSKIVPFIDPWSAVTTSRNDVQYVVTEYGIAELRGHTMRDRARSLIEIAHPDFRDPLKEEFEKRFHTKY

SEQ ID NO: 295 - protein, 432 aa, Anaerofustis stercorihominis
MDLKQIYNSKVKNADDAVKAIKSGNRVVIAHAVGEPVYVVDKMVEHHKDYKDVEIVQLVPMGHSLYAKEEMKEHFRLNAFFLGGNTRDAVFEGRGDFTPCFFYQIPQLFRSCLPIDVALITVSPPDENGFCSFGTSCDYTKPAAEAAKIVIAQVNKKMPRTLGDGFIHINDIDIIVEHDEQVPELPNPKITDVEMKIGENCAKLINDGDTLQLGIGAIPDAVLKFLTHKKDLGIHSEMISDGVMDLYEKGVITCKKKNLHKGKMVVAFLMGTQKLYEFVHDNPAISMMDIEYVNNPIVIGQNDNMVSVNSALQVDLMGQVCAEAMGLKQFSGIGGQVDFIRGAAFSKGGKSILAFPSTAKKGTISKIVPFLTEGSAVTTSRTDVDYIVTEHGIAHLKGQTLKERARRLINIADPNFRDGLIAEFENRFKENF

SEQ ID NO: 296 - protein, 442 aa, Anaerostipes caccae
MRDKKDKPWKAEYREKLVSADEAVSHIRSGQRIVFSHAAGESLVLSDALVRNRALFENVEIVHMVAMGAAKYCEPGMEKHFRHNSFFLGASTRKAAKEGRADVTPVYFSEVPELFRTTLPVDAVFLNLSPPDEHGYCSFGISVDYSKPAAMEAELVIAQINPSMPRTLGDSFIHISDIDYIVEADTPLIELPPAGISEVERAIGKNCASLIEDGDTLQLGIGAIPDAVLGFLKEKKDLGIHSEMISDGIVELYEAGVITNRRKSLHAGKSIVTFLMGTRKLYDFADNNPAVELHPVDYVNDPYVIAQNERLVSVNSCVQVDLMGQVVSASVGRRQISGVGGQVDFVRGANMSRGGKSIMAMPSTAAEGRISKIVPVIGEGAAVTTSRYDADYIVTEYGTARLKGETLRNRARKLIRIAHPDFRRMLAEEYEKRFREAWSDDE

SEQ ID NO: 297 - protein, 438 aa, Clostridium aminobutyricum; identical to SEQ ID NO: 197

SEQ ID NO: 298 - protein, 438 aa, Clostridium aminobutyricum; identical to SEQ ID NO: 197

SEQ ID NO: 299 - protein, 448 aa, Clostridium aminobutyricum
MDWKKIYEDRTCTADEAVKSIKSGDRVLFAHCVAEPPVLVEAMVANAAAYKNVTVSHMVTLGKGEYSKPEYKENFTFEGWFTSPSTRGSIAEGHGQFVPVFFHEVPSLIRKDIFHVDVFMVMVSPPDHNGFCCVGVSSDYTMQAIKSAKIVLAEVNDQVPVVYGDTFVHVSEIDKFVETSHPLPEIGLPKIGEVEAAIGKHCASLIEDGSTLQLGIGAIPDAVLSQLKDKKHLGIHSEMISDGVVDLYEAGVIDCSQKSIDKGKMAITFLMGTKRLYDFAANNPKVELKPVDYINHPSVVAQCSKMVCINACLQVDFMGQIVSDSIGTKQFSGVGGQVDFVRGASMSIDGKGKAIIAMPSVAKKKDGSMISKIVPFIDHGAAVTTSRNDADYVVTEYGIAEMKGKSLQDRARALINIAHPDFKDELKAEFEKRFNAAFSAWSHPQFEK

SEQ ID NO: 300 - protein, 438 aa, Eubacterium saphenum; identical to SEQ ID NO: 195

SEQ ID NO: 301 - protein, 435 aa, Clostridium difficile
MSWRELYQSKLCSATEAVKQIKNGDTVVFAHCVGEPPALVEAMIENAEQYKDVEIKHMVSLGSGGYTAKGMEAHFRVNPMFVSGNVRKAIENGDGDFTPTFFHEVPKLLREKRLKCDVVLAQVTPPDEHGYCSLGTSVDYTYEAIKTARTVIVQVNDQFPRTYGEVVHVSEFDYIVEKSQPLFELQPAKIGEVEEAIGKNCASLIEDGSTLQLGIGGIPDAVMLFLTDKKDLGIHSEMISDGTLALYEKGVINGKYKNFDKEKMTVTFLMGTKKLYDFANNNPAVEVKPVDYVNHPAIIMKQHKMVSINSAIQVDLMGQVVAEAMGLRQFSGVGGQVDFIRGVSMGEDGKAIIAMPSITTKKDGTVISKIVSIVDEGAPITTSRNDVDYIVTEYGIAELKGKSLRERARNLINIAHPSVRESLAVEFEKRFKEKY

SEQ ID NO: 302 - protein, 435 aa, Clostridium difficile
MSWQELYQSKLCSATEAVKQIKNGDTVVFAHCVGEPPALVEAMIENAEQYKDVEIKHMVSLGSGGYTAKGMEAHFRVNPMFVSGNVRKAIENGDGDFTPAFFHEVPKLLREKRLKCDVVLAQVTPPDEHGYCSLGTSVDYTYEAIKTARTVIVQVNDQFPRTYGEVVHVSEFDYIVEKSQPLFELQPAKIGEVEEAIGKNCASLIEDGSTLQLGIGGIPDAVMLFLTDKKDLGIHSEMISDGTLALYEKGVINGKYKNFDKEKMTVTFLMGTKKLYDFANNNPAVEVKPVDYVNHPAIIMKQHKMVSINSAIQVDLMGQVVAEAMGLRQFSGVGGQVDFIRGVSMGEDGKAIIAMPSITTKKDGTVISKIVSIVDEGAPITTSRNDVDYIVTEYGIAELKGKSLRERARNLINIAHPSVRESLAVEFEKRFKEKY

SEQ ID NO: 303 - protein, 435 aa, Clostridium difficile
MSWQELYQSKLCSATEAVKQIKNGDTVVFAHCVGEPPALVEAMIENAEQYKDVEIKHMVSLGSGGYTAKGMEAHFRVNPMFVSGNVRKAIENGDGDFTPAFFHEVPKLLREKRLKCDVVLAQVTPPDEHGYCSLGTSVDYTYEAIKTARTVIVQVNDQFPRTYGEVVHVSEFDYIVEKSQPLFELQPAKIGEVEEAIGKNCASLIEDGSTLQLGIGGIPDAVMLFLTDKKDLGIHSEMISDGTLALYEKGVINGKYKNFDKEKMTVTFLMGTKKLYDFANNNPAVEVKPVDYVNHPAIIMKQHKMVSINSAIQVDLMGQVVAEAMGLRQFSGVGGQVDFIRGVSMGEDGKAIIAMPSITTKKDGTVISKIVSIVDEGAPITTSRNDVDYIVTEYGIAELKGKSLRERARNLIDIAHPSVRESLAVEFEKRFKEKY

SEQ ID NO: 304 - protein, 435 aa, Clostridium difficile
MSWRELYQSKLCSATEAVKQIKNGDTVVFAHCVGEPPALVEAMIENAEQYKDVEIKHMVSLGSGGYTAKGMEAHFRVNPMFVSGNVRKAIENGDGDFTPTFFHEVPKLLREKRLKCDVVLAQVTPPDEHGYCSLGTSVDYTYEAIKTARTVIVQVNDQFPRTYGEVVHVSDFDYIVEKSQPLYELEPAKIGEVEEAIGKNCASLIEDGSTLQLGIGGIPDAVMLFLTDKKDLGIHSEMISDGTLALYEKGVINGKYKNFDKEKMTVTFLMGTKKLYDFVNNNPAVEVKPVDYVNHPAIIMKQHKMVSINSAIQVDLMGQVVAEAMGLRQFSGVGGQVDFIRGVSMGEDGKAIIAMPSITTKKDGTVISKIVSIVDEGAPITTSRNDVDYIVTEYGIAELKGKSLRERARNLINIAHPSVRESLAIEFEKRFKEKY

SEQ ID NO: 305 - protein, 433 aa, Clostridium sp.; identical to SEQ ID NO: 196

SEQ ID NO: 306 - protein, 433 aa, Clostridium arbusti
MNWKDVYKNRLASAKKAVSKIESNSRIVVSHAVGEPLDLMNALVENRNEYKNLEIVHMLAMGKGEYVKPEMKKFFHHNALFVGTSTMEAVKSGRAEYTPCFFYEVPRLFKEGYLSVDVALIQVSEPDQYGYCSFGVSNDYSKPAAESAKLVIAEVNKNMPRILGDSFIHVSDIDYIVESSHPLIELKPPKIGDVEKAIGKYCASLIEDGSTLQLGIGAIPDAVLLFLKDKKDLGIHSEMISDGVVELVEAGVINNKKKTLHKGKIVVTFLMGTKKLYDFVDNNPMVESYSVDYVNNPMVIMKNYKMVSINSCIQVDLMGQVCSESIGLNQISGVGGQVDFIRGASMAEYGKAIIAIPSTAAHGKVSRIVPFLNEGAAITTSRNEVDYIITEYGIAHLKGKTLSDRAQNLINIAHPDFRESLITEFEKRFNCKF

SEQ ID NO: 307 - protein, 436 aa, Lachnospiraceae bacterium; identical to SEQ ID NO: 190

SEQ ID NO: 308 - protein, 431 aa, Lachnospiraceae bacterium
MNWKEYYKQHLMSAEDAVNHIQSGNRVVVAHACGEPSYLLDVMVANAKAYKDVEIVHMVAMGKAEYCKPEYAENFRHNAFFVGGTSRDAIAEGRGDFTPSFFFEVPRQFSSTMPVDVAMVMVTPPDENGMCSLGVSVDYTLEAVKQAKLVIAQVNPQMPWTGPYSLVSVKDLDCIVEHEAPIIELKPPKIGDIEKAIGEHCASLVPDGATLQLGIGAIPDAVLLFLKHKKDLGIHSEMFSDGVVELAEAGVITNAKKTLHPGKFEVAFLMGTRRLYDFVDHNPDVELRPVDYVNNPFVIAQNENMVSINSCVQVDLMGQVASESIGPKQISGVGGQVDFVRGASASKGGVSIMAMPSTVKGKISKIVPLLDEGAAVTTSRNDVDYIVTEYGVAALKGQTLRQRARNLIEIAHPDFRDELKAEYEKRFHCKY

SEQ ID NO: 309 - protein, 436 aa, Clostridium beijerinckii; identical to SEQ ID NO: 194

SEQ ID NO: 310 - protein, 429 aa, Clostridium kluyveri; identical to SEQ ID NO: 192

SEQ ID NO: 311 - protein, 430 aa, Odoribacter splanchnicus
MEWKEIYKNRFATVEEAVRAIEDGDRLVFGHAAGCPQVVPAEMIAQKERLHDVGIYHMLTLNDGSYLTPGTEGHFRHITNFVGGNSRQAVADDRADFLPVFFYEIPQLFDEVYPVDVAVIQVSYPDSEGNCSFGLSCDYTKAAAEKARLVIAEMNENMPYVEGDNKIHISRLDYIIPTNLALPEIPLPKITDVEKAIGRNCASLIEDGSTLQLGIGAIPDAVLLFMGDKKNLGIHTEMFSDGVIDLVESGVVNGSKKTLHPGKLVATFLMGTRRLYDFVDKNACVEMRPVDYVNDPRVIAQNEKMVSINSCIEVDLMGQVASETIGLKQFSGTGGQVDYVRGAAWSAGGKSIMAMPSTAAKGKASRIVPFLAQGAAVTTSRNDVDYVVTEYGIARLKGKTLKQRARALIAVAHPDFRPMLEEEYQKRFKD

SEQ ID NO: 312 - protein, 431 aa, Porphyromonas gingivalis
MKDVLAEYASRIVSAEEAVKHIKNGERVALSHAAGVPQSCVDALVQQADLFQNVEIYHMLCLGEGKYMAPEMAPHFRHITNFVGGNSRKAVEENRADFIPVFFYEVPSMIRKDILHIDVAIVQLSMPDENGYCSFGVSCDYSKPAAESAHLVIGEINRQMPYVHGDNLIHISKLDYIVMADYPIYSLAKPKIGEVEEAIGRNCAELIEDGATLQLGIGAIPDAALLFLKDKKDLGIHTEMFSDGVVELVRSGVITGKKKTLHPGKMVATFLMGSEDVYHFIDKNPDVELYPVDYVNDPRVIAQNDNMVSINSCIEIDLMGQVVSECIGSKQFSGTGGQVDYVRGASWSKNGKSIMAIPSTAKNGTASRIVPIIAEGAAVTTLRNEVDYVVTEYGIAQLKGKSLRQRAEALIAIAHPDFREELTEHLRKRFG

SEQ ID NO: 313 - protein, 433 aa, Fusobacterium ulcerans
MDWREDYKKKVCSPEEAVKKIKSDSRVVICHAAGEPQTVVDAMVQNYKEYKNVEIVHMVALGKCEYMKPEMAGHFRHNGLFLGGGTRDVVNAGNGDYTTSFFFEIPKLFKKGGSMPVDVALIQVSTPDEHGYCSMGITCDYTKAAAENAKCVIAQVNKFMPRVLGDNFIHISEIDVIVERDEPIIVLNPPRIGDIERKIGEYCASLINDGDTLQLGIGAIPDAVLTFLKDKKDLGIHSEMISDGVVELVKAGVINNSRKTLHKGKSIVSFLMGTRKLYDYVDDNPSVEIYPVDYVNDPRVISKNDNIVSINSAIQVDLMGQVNAETMGTKQFSGTGGQVDFVRGTAFALNGKSVIAIPSTASKGKVSRITAYLDEGAAVTTSRNDVQYIITEYGIADLKGKTLRERAKELIKIAHPDFREELAQKALEKYKTL

SEQ ID NO: 314 - protein, 434 aa, Fusobacterium sp.
MENWKERYESKLCTSDEAIKKIAGVKRIIFEHACGESVLLTEALMKNKELFKKTEIIHLVAMGKGEYAKKENSEYFRHNALFAGGTTREAANSSYGDYTPSFFFEMPELFKKGGVLNPDVTIIQVSYPDEHGYCSYGISCDYTKCAAENSNIVIAQVNKFMPRTLGNCFIHIDNINYIVEQATPIIELKIPVIGEIEKRIGEHCASLIDDGATLQLGIGAIPDAVLSFLRHKKDLGIHSEMISDGVVDLVNLGVITNKRKNINTGKSIVSFLMGTRKLYDYIDNNPEIELHPVDYVNNPFIIAQNDNMISINSAIQVDLMGQVNAESIGSKQFSGTGGQVDFVRGAAMSKGGKSIIALPSTAAKGTISKIVFTLDEGAAVTTSRNDVDYIVTEYGIAHLKGKSLRERAKALIEIAHPDFREELKRKAVGKFGTL

SEQ ID NO: 315 - protein, 434 aa, Fusobacterium nucleatum
MGNWKERYESKLCTSDEAIKKIAGVKRIIFEHACGESALLTEALMKNKELFKKTEIIHLVAMGKGEYAKEENSKYFRHNALFAGGTTREAANSSYGDYTPSFFFEMPELFKKGGVLNPDVTIIQVSYPDEHGYCSYGISCDYTKCAAENSNIVIAQVNKFMPRTLGNCFIHIDNIDYIVEQATPIIELKIPVIGEIEKRIGEHCASLIEDGATLQLGIGAIPDAVLSFLRHKKDLGIHSEMISDGVVDLVNLGVITNKKKNINTGKSIVSFLMGTRKLYDYIDNNPEIELHPVDYVNNPFIIAQNDNMISINSAIQVDLMGQVNAESIGSKQFSGTGGQVDFVRGAAMSKGGKSIIALPSTAAKGTISKIVFTLDEGAAVTTSRNDVDYIVTEYGIAHLKGKSLRERAKALIEIAHPDFREELTKKAVGKFGTL

SEQ ID NO: 316 - protein, 434 aa, Fusobacterium nucleatum
MGNWKERYESKLCTSDEAIKKIAGVKRIIFEHACGESALLTEALMKNKELFKKTEIIHLVAMGKGEYAKEENSEYFRHNALFVGGTTREAANSSYGDYTPSFFFEMPKLFKKGGVLNPDVTIIQVSYPDEHGYCSYGISCDYTKCAAENSNIVIAQVNKFMPRTLGNCFIHIDSIDYIVEQATPIIELKIPVIGEIEKRIGEHCASLIDDGATLQLGIGAIPDAVLSFLRHKKDLGIHSEMISDGVVDLVNLGVITNKRKNINVGKSIVSFLMGTRKLYDYIDNNPEIELHPVDYVNNPFIIAQNDNMISINSAIQVDLMGQVNAESIGSKQFSGTGGQVDFVRGAAMSKGGKSIIALPSTAAKGTISKIVFTLDEGAAVTTSRNDVDYIVTEYGIAHLKGKSLRERAKALIEIAHPDFREELTKKAVGKFGTL

SEQ ID NO: 317 - protein, 436 aa, Fusobacterium sp.
MSNNWREVYKDKIVTADEAVKQIKSGDRLIFSHACGEAQEITDALLRNKESYEKVEIIHLVPMGKGEYAQEENQKYFYHNSFFGGGSTRKAINGAYGDFTPSFFFEIPNLFRKNGKLPLDVAIIQVSAPDEHGYCSYGISCDYTKGAAENAKIVIAQVNKYMPRTLGENFIHLSAIDSIVEYDQPILQLNPPKIGEVEKKIGEYCAGLIQDGDTLQLGIGAIPDAVLTFLKEKKHLGIHSEMISDGVVDLILAGVIDNSQKTIHKNKCIVSFLMGSQKLYDYVHNNPGVELYPVDYVNHPFVIAQNDNMVSINSALQVDLMGQVNAESMGAKQFSGTGGQVDFVRGAAMSKGGRSIIAMPSTAAKGTISKIVMNLDVGATVTTSRNDVDYIITEYGIAELKGKTLRERAKALIAIAHPDFREQLTKQALEKFQRLE

SEQ ID NO: 318 - protein, 431 aa, Porphyromonas gingivalis
MKDVLAEYASRIVSAEEAVKHIKNGERVALSHAAGVPQSCVDALVQQADLFQNVEIYHMLCLGEGKYMAPEMAPHFRHITNFVGGNSRKAVEENRADFIPVFFYEVPSMIRKDILHIDVAIVQLSMPDENGYCSFGVSCDYSKPAAESAHLVIGEINRQMPYVHGDNLIHISKLDYIVMADYPIYSLAKPKIGEVEEAIGRNCAELIEDGATLQLGIGAIPDAALLFLKDKKDLGIHTEMFSDGVVELVRSGVITGKKKTLHPGKMVATFLMGSEDVYHFIDKNPDVELYPVDYVNDPRVIAQNDNMVSINSCIEVDLMGQVVSECIGSKQFSGTGGQVDYVRGAAWSKNGKSIMAIPSTAKNGTTSRIVPIIAEGAAVTTLRNEVDYVVTEYGIAQLKGKSLRQRAEALIAIAHPDFREELTEHLRKRFG

SEQ ID NO: 319 - protein, 431 aa, Porphyromonas gingivalis; identical to SEQ ID NO: 56

SEQ ID NO: 320 - protein, 437 aa, Clostridium kluyveri
MVFKNWQDLYKSKIVSADEAVSKVSCGDSIILGNACGASLTLLDALAANKEKYKSVKIHNLILNYKNDIYTDPESEKYIHGNTFFVSGGTKEAVNCNRTDYTPCFFYEIPKLLKQKYINADVAFIQVSKPDSHGYCSFGVSTDYSQAMVQSAKLIIAEVNDQMPRVLGDNFIHISDMDYIVESSRPILELTPPKIGEVEKTIGKYCASLVEDGSTLQLGIGAIPDAVLLFLKDKKDLGIHSEMISDGVVELVEAGVITNKKKSLHPGKIIITFLMGTKKLYDFINDNPMVEGYPVDYVNDPKVIMQNSKMVCINSCVEVDFTGQVCAESVGFKQISGVGGQVDYMRGASMADGGKSILAIPSTAAGGKISRIVPILTEGAGVTTSRYDVQYVVTEYGIALLKGKSIRERAKELIKIAHPKFREELTAQFEKRFSCKL

SEQ ID NO: 321 - protein, 433 aa, Fusobacterium sp.
MDWREDYKRKVCSPEEAVKKIKSDSRVVICHAAGEPQTVVDAMVQNYKEYKNVEIVHMVALGKCEYMKPEMKGHFRHNGLFLGGGTRDVVNAGNGDYTTSFFFEIPKLFKKGGSMPVDVALIQVSTPDEHGYCSMGITCDYTKAAAENAKCVIAQVNKFMPRVLGDNFIHISEIDVIVERDEPIIVLNPPRIGDIERKIGEYCASLINDGDTLQLGIGAIPDAVLTFLKDKKDLGIHSEMISDGVVELVKAGVINNSRKTLHKGKSIVSFLMGTRKLYDYVDDNPSVEIYPVDYVNDPRVISKNDNIVSINSAIQVDLMGQVNAETMGTKQFSGTGGQVDFVRGTAFALNGKSVIAIPSTASKGKVSRITAYLDEGAAVTTSRNDVQYIITEYGIADLKGKTLRERAKELIKIAHPDFREELTQKALEKYKTL

SEQ ID NO: 322 - protein, 434 aa, Fusobacterium sp.
MGNWKERYESKLCTSDEAIKKIAGVKRIIFEHACGESALLTEALMKNKELFKKTEIIHLVAMGKGEYAKEENSEYFRHNALFAGGTTREAANSSYGDYTPSFFFEMPKLFKKGGVLNPDVTIIQVSYPDEHGYCSYGISCDYTKCAAENSNIVIAQVNKFMPRTLGNCFIHIDSIDYIVEQATPIIELKIPVIGEIEKRIGEHCSSLIDDGATLQLGIGAIPDAVLSFLRHKKDLGIHSEMISDGVVDLVNLGVITNKRKNINVGKSIVSFLMGTRKLYDYIDNNPEIELHPVDYVNNPFIIAQNDNMISINSAIQVDLMGQVNAESIGSKQFSGTGGQVDFVRGAAMSKGGKSIIALPSTAAKGTISKIVFTLDEGAAVTTSRNDVDYIVTEYGIAHLKGKSLRERAKALIEIAHPDFREELTKKAVGKFGTL

SEQ ID NO: 323 - protein, 437 aa, Clostridium tetani
MNWEDIYKSKLLSSKEAVLKLKSENHVAVGHAASEPRLLMKALVDNKESFRDLKLYQMIALEKSECAKKGMEKHFSYNSLFVGGGSREAINDGRADYIPCFFSRIPRLFRENYIKLDAALIQVAPPDEHGFCSFGVSSDYIKPAAECAKLVIAEVNDKMPRTLGDNFIHVSDIDYIVENSREIPELKPSNIGDIERAIGENCASLINNGDVLQLGIGAIPDAVLLFLKDKKDLGIHSEMISDGVVDLVKAGVINNKKKTLHQGKIIVSFLMGTKKLYDFVDNNPMVRMYPVDYVNNPVVISKNDNMVSINSCIQIDLMGQIDAETIGFTQISGVGGQIDFIRGAGLSKNGRSIIAIPSTVGNGKISKIVPLLDKGAAVTTTRNEVDYVVTEYGIARLKGKNLRDRARELIKIAHPDFREELKLEYKNRFKEEFKRIG

SEQ ID NO: 324 - protein, 434 aa, Fusobacterium sp.
MGNWKERYESKLCTSDEAIKKIAGVKRIIFEHACGESILLTEALMKNKELFKKTEIIHLVAMGKGEYAKEENSEYFRHNALFAGGTTREAANSSYGDYTPSFFFEMPELFKKGGVLNPDVTIIQVSYPDEHGYCSYGISCDYTKCAAENSNIVIAQVNKFMPRTLGNCFIHIDNIDYIVEQATPIIELKIPVIGEIEKRIGEYCASLIDDGATLQLGIGAIPDAVLTFLRYKKDLGIHSEMISDGVVDLVNLGVITNKRKNINTGKSIVSFLMGTRKLYDYIDNNPEIELHPVEYVNNPFIIAQNDNMISINSAIQVDLMGQVNAESIGSKQFSGTGGQVDFVRGAAMSKGGKSIIALPSTAAKGTISKIVFTLDEGAAVTTSRNDVDYIITEYGIAHLKGKSLRERAKALIEIAHPDFREELRKKAVGKFGAL

SEQ ID NO: 325 - protein, 435 aa, Filifactor alocis
MDWKKIYQERLVSAEEALSHVKSGDHVALGHALAEPTYLLEEMVRLKDNYKNVKFSGLVPGKAPYAAEGLGEHFRTCSMFLGASTRKAVERGDGEFIPRFFYEVPRTYREDWPVDVAMVTLSAPDKHGFCSFGISVDFTKTIAENAKIVIGQVNKYMPRTHGDSFIHISDIDFLVEHDEPLVELPKPHIGEVESKIGEYVASLVNDGDCLQLGIGAIPDAALQFMKDKKDLGIHSEMISDGVMDLMKAGVITNKKKNFHNRRTVVTFLMGTKDLYDYVDDNPFFEMYPVDYVNDPRVVSQNDNMVCINSCIQVDLTGQVVSGSIGPRQFSGVGGQVDFVRGAAWSKGGRNIIAMPSTVKGKMSKIVPVITEGSSVTTSINDVDYIITEYGIAKLGSKSLNERARALINIAHPDFREELAKAYEERFHEKCDYKRD

SEQ ID NO: 326 - protein, 432 aa, Bacteroidetes oral
MRNREKPFGEKIVTADEAVAAIGNGDCVVFSHAAGVPQEIPQALIRNKERFRDVHIYHMLCLGDGEYLSEGFEKHFRHITNFVGANSRKAIEQGRADFMPCFFFEIPYMFRRKQLPVDVAVIQITPPDVMGNCSFGVSCDYTKPAAEEARVVIAEMNENMPCVGGDNFIHISQIDYIVSCANPLPEILPSHIGSVEKAIGGYCAELIENGSTLQLGIGAIPDAVLMSLTDKKDLGIHTEMFTDGVIDLVEKGVINGSKKTLHPRKHIATFLMGSKRLYDFVNNNNTVELYPVDYVNNPYVIMQNADMVSINSCIEVDLMGQVVSECIGSRQFSGAGGQVDYVRGAMLSQGGKSIMAMPSTAAKGTVSRIVPFLAHGAAVTTSRNDVDYVVTEYGIAHLKAKTLKERAKSLISIAHPDFRAELIEEFNERFAQ

SEQ ID NO: 327 - protein, 433 aa, Clostridium sp.
MSFKELYQSKKMDADQALNLIRSGDRVVVGHACAEPSYLLDVLTEKAEQYENVEIVHMVAMGKAGYCAPGMEKHFRHNSLFVGGSTRKAVAEGRGDFTPCFFSEIPKLFKNDSLPVDAALIQTAPPDENGNLSLGISVDYTLQAAKSAKTVIVQVNPQMPVTFGGTIHISDVTAVVEHDAPLLTLEPPVIGDVELAIGANCAGLIRDGDTLQLGIGAIPDAVLRFLGDKKDLGIHSEMFSDGVVELAEAGVITNRLKKTNPGKYVASFLMGTRKLYDFVDGNPDVAMLPVDYVNNPVEVMKEDNIVSVNSCVQIDLMGQAASESVGLTQISGVGGQVDFVRGAAMAANGRSILAFPSTAAKGKISKIVPLLDEGAAVTTSRNDIDYAVTEYGIAKLKGRTLRQRALALIEIAHPDFRDGLRKVFEERFPGRRS

SEQ ID NO: 328 - protein, 429 aa, Porphyromonas endodontalis
MEEYKSKVVSAQEAIRAIKNGDSVVLSHAAGAPQLISRALADNYQNYQDVKIFHMLVLGDAPYCAPEMEGHFRHVTNFVGGNTRQALADGRADFIPLFFYQVPRMFENGAIPVDVAVVHVSEPNEEGYCSYGVSCDYTKPAAERAKVVIAEMNKQMPFVHGDNLIHVSKLDYIVEADYPLYEIALPTIGDVEKAIGDNVAHLVQDGDTLQLGIGAIPDAVLLFLKDKKDLGIHTEMFSDGVLELVRAGVITGKKKEIDNGKLTATFLMGSRDLYDFVNNNPDVRLAPVNWVNDPVTVMNFDRMVSINSCIEVDLMGQVASETIGYKQFSGTGGQVDYVRGASMSGHGVSIMAMPSTAAKGKVSRIVPLLAEGAAVTTSRNDVDYVVTEFGAAKLKGKSLRERAEALISIAHPDFRPQLLEEFNKRFPSK

SEQ ID NO: 329 - protein, 434 aa, Megasphaera elsdenii
MDWRKEYAEKIVSVEEAVSHVQSGNRIVFTHACGEAQALTDELVRQADRLENVEIVHMVAMGKAPYCQPGMEKHFRHNALFVGGSTRKAVEEGRGDYTPCFFHEIPKLFTDGTLPVDVAFLQLSEPDENGICSYGVSVDYTQPAAEAAKLVIAQINKNMPYTYGNGINLKDIDYIVEKDEPLIELQPPKIGETEHKIGEYVASLIHDGDTLQLGIGAIPDAVLSFLGDKKDLGIHSEMFSDGVVDLARKGVITNKKKTIDQGKFVSCFLMGTKKLYDFVNNNPDVLMERVDYTNDPFVVAKIDNIISINSAMQVDLMGQVNAEMIGYKQFSGVGGQVDFVRGASRAKGGKAIIAMPSTAGHGKISKIVPLLDEGAAVTTSRNDVDYIITEFGIAPLKGRTLRQRAIALIKIAHPDFREGLIAEFEKRFHCKFEG

SEQ ID NO: 330 - protein, 464 aa, Desulfatibacillum alkenivorans
MNWQELYNQKCVSASEAVAQIQSGDRVVVGHACGSPETLLAAMVAGKEQYTGVELVHMVSMGPSEYCSEENAVHFFHNSLFAGATSRTAVNQGRGIFTPCHFSQIPRLFTDNILPVDVTLCMISPPDEHGYCSFGISVDYTKPAAESSRLVIAEVTPHMPRTLGDSFIHVSDIDFIVETNAKPLTLPLPKITPTDEAIGGHIAELIKDGDCLQLGIGAVPDSILGFLKDKKDLGVHTEMFSDGVVDLVESGVITCAKKNLHNGKMAATFFMGTERLYKFVHNNPMVMMFPVDYTNSPAVIAQNDNMVSVNSALQVDFNGQVVSDTIGHKQYSGTGGQVDFVRGAAMSKGGRSILAFHSTAAKGKISRVVPRIDPGACVTTARTDVHYIVTEFGVADLRGKSVSERAKALINIAHPEFREDLRAEFENIYLKENPLLRPLPEEHRKRYWPHEARQDFLKQYAQAS

SEQ ID NO: 331 - protein, 438 aa, Peptoniphilus indolicus
MRRDILNWLEEYNSKLVDVHTAIENIKSGNRVVFEHACGEPKYLIDNLVENYKNLENVEIVHMVPMGSAKYCDEGMEKHFKHNGFFLGSNTKKAVHEGRADFTPSFFFEIPKLFRTKMPIDVVLVQVSKPDDFGYVSLGISVDYTKSACENAKIVIAQVNKYMPRTMGESFIHISDIDYIVEYDEPIYTLPRPNIGDVEMKIGKYCSTLIEDGDTLQLGIGAIPDAVLSFLDDKKDLGIHSEMFADGVIDLVKKGVITNKCKNLYKGKMVATFLMGTRELYDFVNDNPMVQMMPVDYVNNPCIIMQEDNLVSINSCVQVDLMGQVASESIGKNQISGVGGQVDFIRGASMAKNGRSIIAMPSTVKGKTSKIVACLDEGAAVTTSRNDVDYIVTEYGIAELKGKTLRQRSEALIRIAHPDFRDELIKAHNMKFNDELKI

SEQ ID NO: 332 - protein, 431 aa, Desulfitobacterium metallireducens
MNNWRDKYQNKIVTADQAVKNVKSGDRVVFGHACGEPEALVEALVNRGSELQDVEIVHMVAMGPGKYSQPEYAANFHHNGLFMGGPTRKALEEKRADYTPCFFSEIPRLFKDGILTVDVAFIQVTPPDEDGYCSYGISCDYTQSVAESAKIVLAQMNRNMPRTGGSRIHLDEIDFIVEQDGALIELQPPKIGDIEKAIGENVASLVQDGATLQLGIGAIPDAVLLFLNDKKDLGIHSEMFSDGVVALAEAGVVTNKRKKVHPGKFIATFLMGTRKLYDFVDNNPDVELYPVDYVNDPFIVGQNDNVVGINSALQVDLMGQVNAEMIGSRQFSGVGGQLDFVRGASRSKNGISIIALPSTASHGKISRISCELDRGAAVTTSRNDVQYIVTEYGIANLRGKNLRQRAAELIGIAHPDFRTQLFDEAKEKGIL

SEQ ID NO: 333 - protein, 430 aa, Acetonema longum
MNWRNTYRERIISAEQALKNVKSGDRVVTGHACGEPPALIEALAARAPELQNVEIVHMVAMGPAKYAQPGMEASFRHNAFFVGGSTRKAVEEKRADYTPCFFSEIPRLFRNNILPVDVALIQVTPPDEAGFCSFGISADYTVAAAECAKITIAQINNNLPRTGGVRIRLDNIQFIVEKDDPLIELKPPAIGDVEKRIGENIAGLIPDGATLQLGIGAIPDAVLLFLKEKKDLGIHSEMFSDGVVALAEAGVVTNRKKSINSGKFMVAFLMGTRKLYDFVHNNPDVELHPVDYINDPYIIGQHENMISINSALQVDCMGQVNAEMIGSRQFSGIGGQVDFVRGVSRSKGGKSIIALPATASGGRISRITCELDRGAAVSTSRNDVHYIVTEYGVANLRGKSLRERAKALIAIAHPDFRETLREEAQRTGVF

SEQ ID NO: 334 - protein, 434 aa, Porphyromonas gingivalis
  MOD_RES (4)..(4): Any amino acid
  MOD_RES (62)..(62): Any amino acid
  MOD_RES (71)..(71): Any amino acid
  MOD_RES (75)..(75): Any amino acid
  MOD_RES (112)..(112): Any amino acid
  MOD_RES (129)..(129): Any amino acid
  MOD_RES (163)..(163): Any amino acid
  MOD_RES (182)..(182): Any amino acid
  MOD_RES (243)..(243): Any amino acid
  MOD_RES (269)..(269): Any amino acid
  MOD_RES (275)..(275): Any amino acid
  MOD_RES (310)..(310): Any amino acid
  MOD_RES (322)..(322): Any amino acid
  MOD_RES (358)..(358): Any amino acid
SNAXKDVLAEYASRIVSAEEAVKHIKNGERVALSHAAGVPQSCVDALVQQADLFQNVEIYHXLCLGEGKYXAPEXAPHFRHITNFVGGNSRKAVEENRADFIPVFFYEVPSXIRKDILHIDVAIVQLSXPDENGYCSFGVSCDYSKPAAESAHLVIGEINRQXPYVHGDNLIHISKLDYIVXADYPIYSLAKPKIGEVEEAIGRNCAELIEDGATLQLGIGAIPDAALLFLKDKKDLGIHTEXFSDGVVELVRSGVITGKKKTLHPGKXVATFLXGSEDVYHFIDKNPDVELYPVDYVNDPRVIAQNDNXVSINSCIEIDLXGQVVSECIGSKQFSGTGGQVDYVRGAAWSKNGKSIXAIPSTAKNGTASRIVPIIAEGAAVTTLRNEVDYVVTEYGIAQLKGKSLRQRAEALIAIAHPDFREELTKHLRKRFG

SEQ ID NO: 335 - protein, 433 aa, Clostridium symbiosum
MSFKELYQSKKMDADQALNLIRSGNRVVVGHACAEPSYLLDVLTEKAEQYENVEIVHMVAMGKAGYCAPGMEKHFRHNSLFVGGSTRKAVAEGRGDFTPCFFSEIPKLFKNGSLPVDAALIQTAPPDENGNLSLGISVDYTLQAAKSAKTVIVQVNPQMPVTFGGTIHISDVTAVVEHDAPLLTLEPPVIGDVELAIGANCAGLIRDGDTLQLGIGAIPDAVLRFLGDKKDLGIHSEMFSDGVVELAEAGVITNRLKKTNPGKYVASFLMGTRKLYDFVDGNPDVAMLPVDYVNNPVEVMKEDNIVSVNSCVQIDLMGQAASESVGLTQISGVGGQVDFVRGAAMAANGRSILAFPSTAAKGKISKIVPLLDEGAAVTTSRNDIDYAVTEYGIAKLKGRTLRQRALALIEIAHPDFRDGLRKVFEERFPGRRS

SEQ ID NO: 336 - protein, 434 aa, Megasphaera sp.
MKDWRTKYASKIVSPAEAVSHVKSGDKIVFSHACGEAQVLTEELVNQAERLHDVEIIHMVAMGPARYCLPEMAGHFRHNALFVGATTRKAVEEGRADYTPCFFHEAPGLFREGIIPVDVVFLQVSEPDENGNCSLGISVDYTQAAAGVAKLKIAQINKNMPYTYGNGIHLDELDYIVEKDEPLIELQPPKIGEIEQCIGEHVASLIKDGDTLQLGIGAIPDAVLSFLGDKKDLGIHSEMFSDGVVDLARKGVITNRRKNIDTGKFLSCFLMGTKKLYDFIDHNPEVWIKPVDYTNDPFVIAQIENIVAINSAMQVDLMGQVNAEMIGRRQFSGVGGQVDFVRGTSRAKGGRAIIAMPSTTGKTKKISKIVAMLDAGAAVTTSRNDVDYIVTEYGIAALKGKTLRQRAEALIAIAHPDFREELKADFAKMFPVSV

SEQ ID NO: 337 - protein, 433 aa, Syntrophothermus lipocalidus
MSWKEYYEKRIVTPEEAAKLIKSNDRVVLGHACGEPKLVVDAMVERAGELENVEVVHMVAMGKARYCQPEYVKSFRHNALFVGAATRNALKEGRGDYTPCFFHEIPGLFRNNVLPVDVALVTVSPPDRHGFVSLGISVDYTRQAVLSAKTVIAEVNPNMPRTGGNSFLEVTDIDYFVLSEEPLYQLSPPEITDVERAIGENVASLIKDGDCLQLGIGAIPDAVLSFLGDKNDIGIHSEMVSDGVMNLVKKGVINCRRKTLHPNKIVITFAMGTAEFYRWLDYNPLIECYTVDYTNDPFVIARNDNMVSINSALAVDLLGQVAADTLGPYQFSGVGGQVDFVRGAARSSGGRSIIAMPATAAQGKASRIVPSLAPGQAVTTSRNDVDYVVTEFGVAKLKGKTVRDRARSLIEIAHPAFRDELREKFSQLMGYSI

SEQ ID NO: 338 - protein, 433 aa, Clostridium symbiosum
MSFKELYQSKKMDADQALNLIRSGDRVVVGHACAEPSYLLDVLTEKAEQYENVEIVHMVAMGKAGYCAPGMEKHFRHNSLFVGGSTRKAVAEGRGDFTPCFFSEIPKLLKNGSLPVDAALIQTAPPDENGNLSLGISVDYTLQAAKSAKTVIVQVNPQMPVTFGGTIHISDVTAVVEHDAPLLTLEPPVIGDVELAIGANCAGLIRDGDTLQLGIGAIPDAVLRFLGDKKDLGIHSEMFSDGVVELAEAGVITNRLKKTNPGKYVASFLMGTRKLYDFVDGNPDVAMLPVDYVNNPVEVMKEDNIVSVNSCVQIDLMGQAASESVGLTQISGVGGQVDFVRGAAMAANGRSILAFPSTAAKGKISKIVPLLDEGAAVTTSRNDIDYAVTEYGIAKLKGRTLRQRALALIEIAHPDFRDGLRKVFEERFPGRRS

SEQ ID NO: 339 - protein, 388 aa, Clostridium novyi
MARFTLPRDIYFGAGCLDVLKTIKGKRAVIVIGGGSIKRSGFLDKIEGYLKEANIETKLIEGVEPDPSVETVMNGAKVMREFNPDLIIGVGGGSPIDAAKAMWIFYEYPEFTFEKAVVPFGLPDLRQKAKFIAIPSTSGTASEVTAFSVITDYKAKIKYPLADFNLTPDIAIVDSDIAQTMPPKLVAHTGMDALTHAIEAYVAGARSAISDPLAMQAIVMVRDNLVKSFEGDKKARDEMHIAQCLAGMAFSNALLGITHSMAHKIGAVFHIPHGCANAIFLPYVIEYNRKACENRYATIARTLGLQGNTDKELVDSLIGLINELNVKLNIPSTIKEWGVSKEDFLKHVDFMAHNAVLDACTGANPREIDDKTMAKLYKCAFYGEKVDF

SEQ ID NO: 340 - protein, 394 aa, Clostridium perfringens
MGGIISMARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACENRYANIARHIGLKGESERELTDDLIDLINKFNKELNIPSSMKEYGIDENEFKANLKFIAHNAVLDPCTGSNPREINDETMEKLYTCAYYGSDVDF

SEQ ID NO: 341 - protein, 393 aa, Dorea formicigenerans
MARFTLPRDIYHGEGALEELKNLKGKKAIVVVGGGAMKRQGFLAKVEDYLKEAGMEVALFEGVEPDPSVETVMKGAKAMQEFEPDWIVAMGGGSPIDAAKAMWAFYEYPEITFEDLITPFSFPELRQKAKFAAIPSTSGTATEVTAFSVITDYAKGIKYPLADFNITPDVAIVDPALVAELPVKQVAYTGMDALTHAIEAYVSTLNCPYTDPLALKAIEMVFDYLPASYRCNMEARAKMHDAQCLAGMAFSNALLGIVHSMAHKTGAAFSTGHITHGLANAMYLPYVIKYNAKDPVAAKRYAEIARFVGLGGASEKALINSLCEKINEFNVILNIPATLKDFGIKEDEFKEKIATISENAVGDACTGSNPRTIDPATMERLFTCIYYGTEVDF

SEQ ID NO: 342 - protein, 396 aa, Clostridium hathewayi
MARFTLPRDLYHGKGALEELKNLKGNKAIVVVGGGSMKRFGFLDRVTDYLKEAGLEVKLFEGVEPDPSVDTVMKGAEMMREFGPDWIVAIGGGSPIDAAKAMWAFYEYPDTTFEELCIPFNFPTLRTKARFCAIPSTSGTATEVTAFSVITDYNKGIKYPLADFNITPDVAIVDPDLAETMPAKLTAFTGMDAMTHAIEAYVSTLHCDYTDPLALHAIKMIHNDLADSYHGDMAARDRMHNAQCLAGMAFSNALLGIVHSMAHKTGAAYSGGHIVHGCANAMYLPKVIKFNAKEAEAAKRYAEIARFIGLKGSTDGELVDALIAELRAMNGKLNIPACIREYEGGIIDEKEFNEKLPSVAELAVGDACTGSNPRPITPAEMEKLLTCCYYDKEVDF

SEQ ID NO: 343 - protein, 395 aa, Clostridiales bacterium
MRFTLPRDLYHGKDAIEALKTLTGKKAFVVVGGGSMKRFGFLDKVVDYLKEAGMEVELFEGVEPDPSVETVMKGAKAMEVFQPDWIVAMGGGSPIDAAKAMWAFYEYPDTSFDDLIIPFNFPTLRTKAKFCAIPSTSGTATEVTAFSVITDYSKGIKYPLADFNITPDVAIVDPALAETMPKKLTAHTGMDAMTHAIEAYVSTLNCEYTDPLALHAIEMINGYLIPSYNGDMEARDKMHDAQCLAGMAFSNALLGIVHSMAHKTGAAYSGGHIVHGCANAMYLPKVIKYNSKEPEAAARYAKIARFINLEGNTDEELTDALIARIREMNKALDIPTCIRDYEGGIIDEKEFMDKLPTVAELAVGDACTGSNPRAITPAEMEKLLKCCFYDEEVTF

SEQ ID NO: 344 - protein, 388 aa, Clostridium celatum; identical to SEQ ID NO: 215

SEQ ID NO: 345 - protein, 388 aa, Clostridium saccharobutylicum
MMRFTLPRDIYYGKGSLEQLKNLKGKKAMLVLGGGSMKRFGFVDKVLGYLKEAGIEVKLIEGVEPDPSVETVFKGAELMRQFEPDWIIAMGGGSPIDAAKAMWIFYEHPEKTFDDIKDPFTVPELRNKAKFLAIPSTSGTATEVTAFSVITDYKTEIKYPLADFNITPDVAVVDSELAETMPPKLTAHTGMDALTHAIEAYVATLHSPFTDPLAMQAIEMINEHLFKSYEGDKEAREQMHYAQCLAGMAFSNALLGICHSMAHKTGAVFHIPHGCANAIYLPYVIKFNSKTSLERYAKIAKQISLAGNTNEELVDSLINLVKELNKKMQIPTTLKEYGIHEQEFKNKVDLISERAIGDACTGSNPRQLNKDEMKKIFECVYYGTEVDF

SEQ ID NO: 346 - protein, 403 aa, Ruminococcus bromii
MYRFTLPRDLYHGEDALSSLKNLSGKKAVVVVGGGSMKRFGFLDKAVDYLKEAGMEVKLIEGVEPDPSVETVMKGAAVMREFEPDWIVAMGGGSPIDAAKAMWVFYEYPNTTFEEIITPFSFPTLRTKAKFCAIPSTSGTATEVTAFSVITDYAKGIKYPLADFNITPDVAIVDPALAETMPAKLTAHTGMDAMTHAIEAYVSTLNCEYTDPLALHAIEMIHDNLKKSYEGDMACRDKMHDAQCLAGMAFSNALLGIVHSMAHKTGAAFTGGHIIHGCANAMYLPKVIKYNSKDPVAAERYAKIAKFINLKGETTEELVDALIAELRSMNDQLNIPQGIKNYGPGGVKADESIIDEKEFLEKLPEVAKNAIADACTGSNPRQPNQEEMEKLLKACYYDTEIDF

SEQ ID NO: 347 - protein, 388 aa, Clostridium botulinum
MERFTLPRDLYFGEGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNSESCGERYATIAKKLGLAGENQDELVKSLIEMIREMNKTMNIPLNLKEYGITEEDFKENVKYISHNAVLDACTGSNPREINDETMEKLFACTYYGEDVTF

SEQ ID NO: 348 - protein, 388 aa, Clostridium butyricum
MARFTLPRDLYHGEGALEALKTLKGKKAFVVVGGGSMKRFGFLQKVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYTEKIKYPLADFNLTPDVAIVDPALAQTMPAKLVAHTGMDALTHAIEAYTASLRSNFSDPLAIKAIEMVNENLVKSYEGDKVARDLMHEAQCLAGMSFSNALLGIVHSMAHKVGAVFHIPHGCANAIFLPYVIQYNRKSCEDRYADIARALKLEGNTDAELTDSLIKLINEFNNKLSIPHSMKEYGIEEAEFKANLEFIAHNAVLDACTGSNPREIDDATMAKLFECTYYGTEVNL

SEQ ID NO: 349 - protein, 388 aa, Clostridium sp.
MNRFTLPRDIYYGENSLEVLKTLEGKKAIVVTGGSSMRKNGFLDKIINFLEEAKIEVKLFEGVEPDPSIETVMKGAEMMREFAPEWIVAVGGGSPIDAAKAMWVFYEHPELTFDDIKDPFTIPALRKKAKFVAIPSTSGTATEVTAFSVITDYKKKIKYPLADFNITPDIAILDTELTMTMPKKLVAHTGMDALTHAIEAYVATNKSHFSDPLAMEAIIMIEDNILKSYEGVKEARDEMHNAQCLAGMAFSNALLGITHSMAHKTGAVFHIPHGCANAIFLPYVIQFNKKACGERYAKIARTLGLAGGNEEELINSLIDCIRQLNKAMEIPLTLKEYGVEKEEFDKYIDFISENAVVDACTASNPREISVDEMKKIFECTFDGVDVEF

SEQ ID NO: 350 - protein, 428 aa, Clostridiales sp.
  Butyrate-producing bacterium SSC/2
MMYNVFVAKQSIEIGYSNVGYIRKGSISVIQVKEMLVMARFTLPRDLYFGENALETLKTIKGNKAVLCLGGGSMKRFGFVDKVVEYLKEAGIETKLIEGIEPDPSVETVMKGAKVMQEFEPDLIIAMGGGSPIDAAKAMWVFYEHPETTFDDIKDPFTIPPLRNKATFIAIPSTSGTATEVTAFSVITDYSTGIKYPLADFEITPDVAIVDPSLAETMPQTLTAHTGMDALTHAIEAYVAGLHSPFSDPLAIHAIEMIFDNLKASYEGDMQARGNMHIAQCLAGMAFSNALLGIVHSLAHKTGAVFDTGHIPHGCANAIYLPYVIQYNAKVCEDRFAMIARKLGLPGVTDKALTLSLIKAVEDLRTSLHIVSNLKEFGVKEDEFLEKKHMIAERAVGDACTGSNPRETSVEDMEKILECIYYGKDVTF

SEQ ID NO: 351 - protein, 388 aa, Clostridium botulinum
MERFTLPRDLYFGEGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNYKSCGERYATIAKKLGLAGENQDELVKSLIEMIREMNKTMNIPLNLKEYGITEEDFKENVKYISHNAVLDACTGSNPREINDEAMEKLFACTYYGEDVTF

SEQ ID NO: 352 - protein, 388 aa, Clostridium botulinum
MERFTLPRDLYFGEGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAIQAIVMVKEYLVKSYNGNKEARGQMHLAQCLAGMAFSNALLGITHSMAHKTGAVFHIPHGCANAIFLPYVIQYNSKSCGERYATIAKKLGLAGENQDELVKSLIEMIREMNKTMNIPLNLKEYGITEEDFKENVKYISHNAVLDACTGSNPREINDETMEKLFACTYYGEDVTF

SEQ ID NO: 353 - protein, 388 aa, Clostridium kluyveri
MGRFTLPRDIYFGENALENLKNLDGNRAVIVVGGGSMKRFGFLNKVEEYLKKAGIEVKLIEGVEPDPSVDTVINGAKIMRDFKPDWIVAMGGGSPIDAAKAMWIFYEYPDFTFEKAIVPFGLPKLRGKAQFVAIPSTSGTATEVTAFSVITDYKSKIKYPLADFNLTPDAAIIDPALAETMPKKLTAHTGMDALTHAIEAYVASLHSDFSDPLAMHAIIMIHKYLLKSYEADKEARGHMHIAQCLAGMAFSNALLGITHGIAHKTGAVFHIPHGCANAIYLPYVIDFNKKVCSEKYVEIAKRLKLPGNNEDELIDSLTEMIRNMNKKMDIPLTIKEYGISEIDFNENLDFIAHNAIMDACTGSNPRKITEEEMRKLLQYMYNGRKVNF

SEQ ID NO: 354 - protein, 393 aa, Clostridium leptum
MSRFTLPRDIYYGKGSIDELKNLKGKKAIVVVGGGSMKRFGFLDKVVNNLHEAGIETMLFEGVEPDPSVETVMKGAKAMQEFQPDWIVSIGGGSPIDAAKAMWAFYEYPDTKFEDLITPFGFPTLRQKAKFLAIPSTSGTATEVTAFSVITDYHKGIKYPLADFNITPDVAIVDPDLAETMPPKLTAHTGMDALTHAIEAYVSTLNSPFTDPLALKAISMVFEYLPDSYNGNMAAREQMHYAQCLAGMAFSNALLGIVHSMAHKTGAAYSTGHIPHGCANAIYLPYVIQYNAKDATAKKRYAAIAKSVGLAGNTDDELVAALCAKIDDYNVKLNIPKTLKDFGINEAEFLEKLPEVAANAVGDACTGSNPRSITPAQMEQLLKATYYGTKVDF

SEQ ID NO: 355 - protein, 388 aa, Clostridium botulinum
MARFTLPRDLYHGEGSLETLKTLKGKKAFVVVGGGSMKRFGFLQKVEDYLKEAGMEVQLFEGVEPDPSVETVMKGAEAMRNFQPDWIVAMGGGSPIDAAKAMWIFYEYPDFTFEQAVVPFGLPDLRQKAKFVAIPSTSGTATEVTAFSVITDYKAKIKYPLADFNITPDIAIVDPELAQTMPAKLVAHTGMDALTHAIEAYTASLRSNFSDPLAIKAIEMVNENLVKSFEGDKEARNLMHEAQCLAGMAFSNALLGIVHSMAHKVGAVFHIPHGCANAIFLPYVIEYNRVECEDRYADIARALKLEGNTDAELTDSLIKLINDFNDKLNIPHSMKEYGVEEADFKANVEFIAHNAVLDACTGSSPRAIDDKTMEKLLGCTFYGTKVNF

SEQ ID NO: 356 - protein, 394 aa, Clostridium perfringens
MGGIISMARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACEDRYANIARHIGLKGESERELTDALIDLINKFNKELNIPSSMKEYGIEEDDFKANLKFIAHNAVLDPCTGSNPREIDDETMEKLYTCAYYGSDVDF

SEQ ID NO: 357 - protein, 388 aa, Clostridium perfringens
MARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGNMEARGEMHEAQCLAGMAFSNALLGIVHSMAHKVGAVFHIPHGCANAIFLPYVIKYNRKACEDRYANIARHIGLKGESERELTDALIDLINKFNKELNIPSSMKEYGIEEDDFKANLKFIAHNAVLDPCTGSNPREIYDETMEKLYTCAYYGSDVDF

SEQ ID NO: 358 - protein, 386 aa, Clostridium carboxidivorans
MSRFTLPRDIYFGENTLETLKTLKGKKAIIVVGGGSMKKFGFLQKVEEYLKEAGMEIKLIEGVEPDPSVETVMKGAEIMRDFEPDWIVSIGGGSPIDAAKAMWIFYEYPEFTFEQAVVPFGIPDLRQKAKFVAIPSTSGTATEVTAFSVITDYKAKIKYPLADFNLTPDVAIIDPALAQTMPAKLTAHTGMDALTHAIEAYVAGLRSYFSDPLAMQAIVMTKDNLIKSYEGDKEARDEMHIAQCLAGMAFSNALLGITHSMAHKTGAVFHIPHGCANAIFLPYVIDFNKKTCKDRYATIAKTLGLAGNTDDELVDALTSMIQEMNKKMDIPLNLKEYGVTEEDFNENLDFIAHNAVLDACTGSNPRPITEEEIEKSIQMHIYWRES

SEQ ID NO: 359 - protein, 388 aa, Clostridium ljungdahlii
MGRFTLPRDIYFGENALENLKNLDGNKAVVVVGGGSMKRFGFLAKVEKYLKETGMEVKLIEGVEPDPSVDTVMNGAKIMRDFNPDWIVSIGGGSPIDAAKAMWIFYEYPDFTFEKAVVPFGIPKLRQKAQFVAIPSTSGTATEVTSFSVITDYKAKIKYPLADFNLTPDIAIIDPSLAETMPKKLTAHTGMDALTHAIEAYVASLHSDFSDPLAMHAITMIHKYLLKSYEEDKEARGHMHIAQCLAGMAFSNALLGITHSIAHKTGAVFHIPHGCANAIYLPYVIDFNKKACSERYAKIAKKLHLSGNSEDELIDSLTEMIRTMNKKMDIPLTIKDYGISENDFNENLDFIAHNAMMDACTGSNPRAITEEEMKKLLQYMYNGQKVNF

SEQ ID NO: 360 - protein, 395 aa, Clostridium citroniae
MRFTLPRDLYHGEHALDALKTLTGKKAFVVVGGGSMKRFGFLDKVVDYLKEAGMEVQLFEGVEPDPSVETVMKGAKAMEEFNPDWIVAMGGGSPIDAAKAMWAFYEYPDTSFEDLIIPFNFPTLRTKAKFCAIPSTSGTATEVTAFSVITDYSKGIKYPLADFNITPDVAIVDPALAETMPKKLTAHTGMDAMTHAIEAYVSTLNCEYTDPLALHAIEMINEYLIPSYNGDMEARDKMHNAQCLAGMAFSNALLGIVHSMAHKTGAAYSGGHIVHGCANAMYLPKVIKYNSKEPEAAARYAKIAKFINLPGTTDQELTDALIARIREMNKELDIPTCIRDYEGGIIDEKEFMEKLPAVAELAVGDACTGSNPRSITPAQMEKLLTCCFYDEEVTF

SEQ ID NO: 361 - protein, 388 aa, Lachnospiraceae bacterium; identical to SEQ ID NO: 214

SEQ ID NO: 362 - protein, 388 aa, Clostridium sporogenes
MERFTLPRDLYFGEGSLEALKTLKGKKAVVVVGGGSMKRFGFLDKVESYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIIMVKEYLVKSYNGNKGARGQMHLAQCLAGMAFSNALLGITHSMAHKTGAVFHIPHGCANAIFLPYVIQYNAKSCGERYATIAKKLGLAGENQDELVKSLIEMIREMNKTMNIPSNLKEYGIAEEEFKENVKYISHNAVLDACTGSNPREIDDETMEKLFACTYYGEDVAF

SEQ ID NO: 363 - protein, 394 aa, Clostridium perfringens; identical to SEQ ID NO: 221

SEQ ID NO: 364 - protein, 388 aa, Clostridium saccharoperbutylacetonicum; identical to SEQ ID NO: 218

SEQ ID NO: 365 - protein, 388 aa, Clostridium perfringens
MARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPELRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACEDRYANIARHIGLKGESERELTDALIDLINKFNKELNIPSSMKEYGIEEDDFKANLKFIAHNAVLDPCTGSNPREIDDETMEKLYTCAYYGSDVDF

SEQ ID NO: 366 - protein, 393 aa, Ruminococcus gnavus
MSRFCLPRDIYHGKGCLEELKNLKGKKAILVVGGGSMKRQGFLDRAVTYLKEAGMEVQLFEGVEPDPSVETVMKGAEAMRAFEPDWIVAMGGGSPIDAAKAMWAFYEYPDVTFEDLCIPFNFPELRQKAKFAAIPSTSGTATEVTAFSVITNYQTGVKYPLADFNITPDVAIVDPDLVAGLPVKQVAYTGMDALTHAIEAYVSTLNGPFTDPLALQAIEMVLDNLPASYNCDMDAREQMHYAQCLAGMAFSNALLGIVHSMAHKTGAAFSTGHIPHGCANAIYLPYVIKYNAKDPVAAKRYAEIARRMGLPGASEKALINSLVEKIDDFNVKLNIPKTLKDFGIEENEFKEKVAKIAELAVGDACTGSNPRAIDPATMEKLFTCTYYGTEVDF

SEQ ID NO: 367 - protein, 393 aa, Lachnospiraceae bacterium
MARFTLPRDIYHGKGCLEELKNLKGKKAILVVGGGSMKRQGFLDKAVNYLKEAGMEVQLFEGVEPDPSVETVMKGAEAMRAFGPDWIVAMGGGSPIDAAKAMWAFYEYPDVTFEDLCIPFNFPELRQKAKFAAIPSTSGTATEVTAFSVITDYAKGIKYPLADFNITPDVAIVDSELVEALPAHQVAYTGMDALTHAIEAYVSTLNCAYTDPLAIQAIEMVFDYLPASFKGNMEARAQMHNAQCLAGMAFSNALLGIVHSMAHKTGAAFSTGHITHGLANAMYLPYVIKYNAKDPVAAKRYAEIARRVGLAGASERALINSLCEKINEFNVILGIPATLKEFGIKEDEFKEKISEIAKNAVGDACTGSNPRAIDPETMERLFTCIYYGTEVDF

SEQ ID NO: 368 - protein, 391 aa, Lachnospiraceae bacterium
MARFTLPRDLYFGENALETLKTIKGNKAVLCLGGGSMKRFGFVDKVVEYLKEAGIETKLIEGIEPDPSVETVMKGAKVMQEFEPDLIIAMGGGSPIDAAKAMWVFYEHPETTFDDIKDPFTIPPLRNKATFIAIPSTSGTATEVTAFSVITDYSTGIKYPLADFEITPDVAIVDSSLAETMPQTLTAHTGMDALTHAIEAYVAGLHSPFSDPLAIHAIEMIFDNLKASYEGDMQARGNMHIAQCLAGMAFSNALLGIVHSLAHKTGAVFDTGHIPHGCANAIYLPYVIQYNAKVCEDRFAMIARKLGLPGVTDKALTLSLIKAVEDLRTSLHIVSNLKEFGVKEDEFLEKKHMIAERAVGDACTGSNPRETSVEDMEKILECIYYGKDVTF

SEQ ID NO: 369 - protein, 388 aa, Clostridium carboxidivorans
MSRFTLPRDIYFGENSLEVLKTLKGKKAVVVVGGGSMKKFGFLQKVEEYLKEAGIKIKLIEGVEPDPSVETVMNGAKVMREFQPDLIVAIGGGSPIDAAKAMWIFYEYPDFTFEKAVIPFGIPDLRQKAKFVAIASTSGTATEVTAFSVITDYKAKIKYPLADFNLTPDIAIVDPALAQTMPPKLTAHTGMDALTHAIEAYVASSRSYISDPLAIQAITMIQEFLIKSYEGDKEARGEMHVAQCLAGMAFSNALLGIAHSMAHKTGAVFHIPHGCANAIFLPYVIDFNKKSCGDRYANIAKALGFNGKTKDELIDDLTDFVKTLNKKMNIPQTLKDYGIKEADFNANLDFIAHNAMGDACTGSNPRAITEAEMKKLFQCTFTGEKVEF

SEQ ID NO: 370 - protein, 388 aa, Clostridium butyricum
MARFTLPRDIYHGEGSLEVLKTLKGKKAFVVVGGGSMKRFGFLQKVEDYLKEAGMEVELFEGVEPDPSVETVMKGAEAMRKFQPDWIVAMGGGSPIDAAKAMWIFYEYPDFTFEQAVVPFGLPELRQKAKFVAIPSTSGTATEVTAFSVITNYTEKIKYPLADFNITPDIAIVDPELAQTMPAKLVAHTGMDALTHAIEAYTASLRSNFSDPLAIKAIEMVNENLVKSFEGDKTARNLMHEAQCLAGMAFSNALLGIVHSMAHKVGAVFHIPHGCANAIFLPYVIKYNRKVCEDRYADIARALKLEGNTDAELTDSLIKLINEFNDDLSIPHSMKEYGVEEADFKSNVKFIAHNAILDACTGSSPREIDEETMEKLFECTYYGTDVNF

SEQ ID NO: 371 - protein, 388 aa, Clostridium perfringens
MARFTLPRDIYHGKDSLEVLKGLEGKKAFIVIGGGSMKRFGFLDKVLSYLKEAGMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSFKGDMEARGEMHEAQCLAGMAFSNALLGIVHSMAHKVGAVFHIPHGCANAIFLPYVIKYNRKACEDRYAQIARHIGLKGESERELTDALVDLINKFNKELNIPSSMKEYGIDENEFKANLKFIAHNAVLDPCTGSNPREVDDETMEKLYTCAYYGSDVDF

SEQ ID NO: 372 - protein, 388 aa, Clostridium botulinum
MERFTLPRDLYFGEGSLEALKTLKGKKAVVVVGGGSMKRFGFLDKVQSYLNEADIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNSESCGERYATIAKKLGLAGENQDELVKSLIEMIREMNKTMNIPLNLKEYGITEEDFKENVKYISHNAVLDACTGSNPREINDETMEKLFACTYYGEDVTF

SEQ ID NO: 373 - protein, 388 aa, Clostridium botulinum
MERFTLPRDLYFGKGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPDFTFEQAVIPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNSKSCGERYATIAKKLGLAGENQDELVKSLIEMIREMNKTMNIPLNLKEYGIAEEDFKENVKYISHNAVLDACTGSNPREINDETMEKLFACTYYGEDVTF

SEQ ID NO: 374 - protein, 393 aa, Lachnospiraceae bacterium
MSRFTLPRDIYHGKGCLEELKNLKGKRAILVVGGGSMKRQGFLDKAVNYLKEAGMEVQLFEGVEPDPSVETVMKGAEAMRAFEPDWIVAMGGGSPIDAAKAMWAFYEYPDVTFEDLCIPFNFPELRQKAKFAAIPSTSGTATEVTAFSVITDYAKGIKYPLADFNITPDVAIVDSELVEGLPAHQVAYTGMDALTHAIEAYVSTLNCAYTDPLAIQAIEMVFDYLPASFRGNMTARAKMHDAQCLAGMAFSNALLGIVHSMAHKTGAAFSTGHITHGLANAMYLPYVIKYNAKDPVAAKRYAEIARRVGLEGSSEQSLINSLCEKINEFNVILGIPATLKEFGIKEDEFKEKVSAVAENAVGDACTGSNPRAIDPATMERLFTCIYYGTEVDF

SEQ ID NO: 375 - protein, 393 aa, Flavonifractor plautii
MSRFTLPRDIYYGANALENLKNLKGSRVVLVLGGGSMKKFGFVDKALGYLKEAGIETRLIENVEPDPSVETVMSGAAVMREFEPDWIISMGGGSPIDAAKAMWAFYEYPETTFEDLITPFSFPELRQKARFCAIPSTSGTATEVTAFSVITDYQKGIKYPLADFNITPDVAIIDPALAETMPPKLVAHTGMDALTHAIEAYVSTLHTVFTDPLALKAIHIVEKDLLRSFNGDMGCREEMHYGQCLAGMAFSNALLGIVHSMAHKTGAAFSTGHITHGLANAMYLPYVIAYNAKADGVAERYADIARTMGVVGDTTAELVEGLRAKIRSMNDAMGIPNTLKDFGIIEDEFKEKLDAIAANAVGDACTGSNPRPIDPATMAKLFTCIYYGTEVDF

SEQ ID NO: 376 - protein, 395 aa, Clostridium bolteae
MRFTLPRDLYHGKDALEALKTLAGKKAIVVVGGGSMKRFGFLDKVVDYLKEAGMEVQLFEGVEPDPSVDTVLKGAAAMQEFEPDWIVAVGGGSPIDAAKAMWAFYEYPDTSFEDLITPFSFPTLRTKAKFCAISSTSGTATEVTAFSVITDYKKGIKYPLADFNITPDVAIVDPALAETMPKKLTAHTGMDAMTHAIEAYVSTLHCEYTDPLALHAIEMINEYLIPSYNGDMEARDKMHDAQCLAGMAFSNALLGIVHSMAHKTGAAYSGGHIVHGCANAMYLPKVIKFNSKEPEAAARYAKIAKFINLPGTTDEELTDALIARLLEMNKALDIPACIKDYEGGIIDEKEFMDKLPKVAELAVGDACTGSNPRTITPEVMEQLLKCCYYDEEVDF

SEQ ID NO: 377 - protein, 397 aa, Clostridium kluyveri
MNSIMRRKVMGRFTLPRDIYFGENALENLKNLDGNRAVIVVGGGSMKRFGFLNKVEEYLKKAGIEVKLIEGVEPDPSVDTVINGAKIMRDFKPDWIVAMGGGSPIDAAKAMWIFYEYPDFTFEKAIVPFGLPKLRGKAQFVAIPSTSGTATEVTAFSVITDYKSKIKYPLADFNLTPDAAIIDPALAETMPKKLTAHTGMDALTHAIEAYVASLHSDFSDPLAMHAIIMIHKYLLKSYEADKEARGHMHIAQCLAGMAFSNALLGITHGIAHKTGAVFHIPHGCANAIYLPYVIDFNKKVCSEKYVEIAKRLKLPGNNEDELIDSLTEMIRNMNKKMDIPLTIKEYGISEIDFNENLDFIAHNAIMDACTGSNPRKITEEEMRKLLQYMYNGRKVNF

SEQ ID NO: 378 - protein, 394 aa, Clostridium perfringens
MGGIISMARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSFKGDMEARGEMHEAQCLAGMAFSNALLGIVHSMAHKVGAVFHIPHGCANAIFLPYVIKYNRKACEDRYANIARHIGLKGESERELTDALIDLINKFNKELNIPSSMKEYGIDENEFKTNLKFIAHNAVLDPCTGSNPREVDDETMEKLYTCAYYGSDVDF

SEQ ID NO: 379 - protein, 388 aa, Clostridium sp.
MARFTLPRDLYHGEGALEVLKTLKGKKAFVVVGGGSMKRFGFLKQVEDYLTEAGMEVELFEGVEPDPSVETVMKGAEAMRNFEPDWIVAMGGGSPIDAAKAMWIFYEYPEFTFEQAVVPFGLPELRQKAKFVAIPSTSGTATEVTAFSVITNYTEKIKYPLADFNITPDIAIVDPVLAQTMPKTLTAHTGMDALTHAIEAYTASLRSNFSDPLAIKALQMVQQNLLKSFEGDKEARNLMHEAQCLAGMAFSNALLGIVHSMAHKVGAVFHIPHGCANAIFLPYVIQYNRTKCEDRYADIARALKLEGSTDSELTDSLIGMINKMNSDLNIPHSMKEYGVTEDDFKANLSFIAHNAVLDACTGSNPREIDDATMEKLFECTYYGTKVEL

SEQ ID NO: 380 - protein, 388 aa, Clostridium colicanis
MARFTLPRDLYHGKGSLEVLKSIKGKKAFVVVGGGSMKRFGFLDKVESYLKEAGIEVEIFEGVEPDPSVETVMKGAEAMRKFQPDWIVAMGGGSPIDAAKAMWIFYEYPDFTFEKAVVPFGLPELRQKAKFIAIPSTSGTATEVTAFSVITNYTEKIKYPLADFNLTPDIAIVDPDLAQTMPKKLVAHTGMDALTHGIEAYTASLRSNFSDPLAAKGIKMVVENLLKSFEGGEKAREEMHDAQCLVGMAFSNALLGIVHSMAHKTGAVFHIPHGCANAIFLPYVIKYNRKNCEDRYADIARMLKLEGNTDSELTDSLINLINEMNTNLEIPHTMKEYGVEEEDFKDNLEFISKNAVLDACTGSNPREIDDKTMEKLFTCAYYGTEVDF

SEQ ID NO: 381 - protein, 388 aa, Clostridium botulinum
MERFTLPRDLYFGEGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPEFTFEQAVIPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNSKSCGERYATIAKKLGLAGENQDELVKSLIEMIREMNKTMNIPSNLKEYGITEEDFKENVKYISHNAVLDACTGSNPREINDETMEKLFACTYYGEEVTF

SEQ ID NO: 382 - protein, 388 aa, Clostridium ljungdahlii
MARFTLPRDIYFGENSLETLKDLDGKKAVIVVGGGSMKRFGFLDKVVNYLKEAGIESKLIEGVEPDPSVETVMNGAKLMREYEPDLIVSIGGGSPIDAAKAMWIFYEYPEFTFKEAVVPFGLPKLRQKATFIAIPSTSGTATEVTAFSVITDYKAKIKYPLADFNLTPDIAIIDPALAQTMPPKLTAHTGMDALTHAIEAYVAGLHSVFSDPLAIQAIVMVNQYLIKSYNEDKEARNQMHLAQCLAGMAFSNALLGITHSLAHKTGAVFHIPHGCANAIYLPYVIDFNKKACAPRYAEIARSLKLPGNTDDELVDSLTNMIKDMNKSMDIPLTLKDYGVDEKEFKDSEDFIAHNAVLDACTGSNPRSINDTEMKKLLEYIYYGKKVDF

SEQ ID NO: 383 - protein, 388 aa, Clostridium cellulovorans
MNRFTLPRDLYFGKGSMEQLKNLKGKKAVIVVGGGSMKKFGFLDKAIGYLQEAGIETRLIEGVEPDPSVETVFKGAEAMREFEPDWIISIGGGSPIDAAKAMWVFYEHPELTFDDIKDPFTIPELRNKAKFVAIPSTSGTATEVTAFSVITDYKTEIKYPLADFNITPDIAIVDSELAETMPKTLTAHTGMDALTHAIEAYVAGLHSDFSDPLAIKAIEMIYDELLKSYNEDKDAREKMHYAQCLAGMAFSNALLGITHSMAHKTGAVFHIPHGCANAIYLPYVIEFNKKVAAERYADIAKRIGLKGETTDELVDALVKSIRDLNVKMDIPLTLKDYGIDEALFKEKVALISERAIGDACTGSNPRTITVTEMEKLFNCTYYGIKVDF

SEQ ID NO: 384 - protein, 393 aa, Lachnospiraceae bacterium
MSRFCLPRDIYHGKGCLEELKNLKGKKAILVVGGGSMKRQGFLDRAVGYLKEAGMEVQLFEGVEPDPSVETVMKGAEAMRAFEPDWIVSMGGGSPIDAAKAMWAFYEYPDTTFEELCTPFNFPELRQKAKFCAIPSTSGTATEVTAFSVITNYQTGVKYPLADFNITPDVAIVDPDLVAGLPVKQVAYTGMDALTHAIEAYVSTLNGPFTDPLALQAIEMVLDYLPASYNCNMDAREQMHYAQCLAGMAFSNALLGIVHSMAHKTGAAFSTGHIPHGCANAIYLPYVIQYNAKDSVAAKRYAEIARRMGLEGNSEKALINSLVAKIDEFNAKLNIPKTLKDFGINEEEFKEKIAKISELAVGDACTGSNPRAIDPAAMEKLFTCTYYGTEVDF

SEQ ID NO: 385 - protein, 393 aa, Clostridium sp.
MSRFTLPRDVYHGKGCLEELKNLRGKKAIIVVGGGSMKRQGFLDRAVGYLKEAGMEVELFEGVEPDPSVETVMKGAEAMRAFEPDWIVSMGGGSPIDAAKAMWAFYEYPDVTFEDLCIPFNFPELRQKAKFCAIPSTSGTATEVTAFSVITNYSTGVKYPLADFNITPDVAIVDPDLVTGLPVKQVAYTGMDALTHAVEAYVSTLNGPFTDPLALQAIEMVLDYLPASYHCNMDAREQMHYAQCLAGMAFSNALLGIVHSMAHKTGAAFSTGHIPHGCANAIYLPYVIKYNAKEPTAASRYAEIARRMGLEGTSEKALINSLCAKIDAFNVELNIPKTLKDFGINEDEFKEKVAKIAELAVGDACTGSNPRAIDPAAMEQLLTCTYYGTEVDF

SEQ ID NO: 386 - protein, 388 aa, Clostridium butyricum
MARFTLPRDIYHGEGSLEVLKTLKGKKAFVVVGGGSMKRFGFLQKVENYLKEAGMEVELFEGVEPDPSVETVMKGAEAMRKFQPDWIVAMGGGSPIDAAKAMWIFYEYPDFTFEQAVVPFGLPELRQKAKFVAIPSTSGTATEVTAFSVITNYTEKIKYPLADFNITPDIAIVDPELAQTMPAKLVAHTGMDALTHAIEAYTASLRSNFSDPLAIKAIEMVSENLVKSFEGDKTARNLMHEAQCLAGMAFSNALLGIVHSMAHKVGAVFHIPHGCANAIFLPYVIKYNRKVCEDRYADIARALKLEGNTDSELTDSLIKLINEFNDDLSIPHSMKEYGVEEADFKSNVKFIAHNAILDACTGSSPREIDEETMEKLFECTYYGTDVNF

SEQ ID NO: 387 - protein, 388 aa, Clostridium botulinum
MARFTLPRDLYHGEGSLETLKTLKGKKAFVVVGGGSMKRFGFLQKVEDYLKEAGMEVQLFEGVEPDPSVETVMKGAEAMRNFEPDWIVAMGGGSPIDAAKAMWIFYEYPDFTFEQAVVPFGLPDLRQKAKFVAIPSTSGTATEVTAFSVITDYKAKIKYPLADFNITPDIAIVDPELAQTMPAKLVAHTGMDALTHAIEAYTASLRSNFSDPLAIKAIEMVNEHLVKSFEGDKEARNLMHEAQCLAGMAFSNALLGIVHSMAHKVGAVFHIPHGCANAIFLPYVIQYNRIECEDRYGDIARALKLEGNTDAELTDSLIKLINDFNDALNIPHSMKEYGVEEADFKANVEFIAHNAVLDACTGSSPRAIDDKTMEKLLGCTFYGTKVNF

SEQ ID NO: 388 - protein, 328 aa, Clostridium botulinum
MERFTLPRDLYFGEGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNSESCGERYATIAKKLGLAGENQDELVKSLIEMIREMNKTM

SEQ ID NO: 389 - protein, 393 aa, Ruminococcus torques
MSRFCLPRDIYHGKGCLEELKNLKGKKAILVVGGGSMKRQGFLDKAVNYLKEGGMEVQLFEGVEPDPSVETVMKGAEAMRAFEPDWIVAMGGGSPIDAAKAMWAFYEYPEISFEDLITPFSFPELRQKAKFAAIPTTSGTATEVTAFSVITNYQTGVKYPLADFNITPDVAIVDPDLVAGLPVKQVAYTGMDALTHAIEAYVSTLNGPFTDPLALQAIEMVLDYLPGSYKCDMVAREQMHYAQCLAGMAFSNALLGIVHSMAHKTGAAFSTGHIPHGCANAIYLPYVIKYNAKDAVAAKRYAEIARRMGLAGTSEQALINSLVEKIDEFNVRLNIPKTLKDFGINEEEFKEKVDKIAELAVGDACTGSNPRAIDPAAMAKLLTCTYYGTEVDF

SEQ ID NO: 390 - protein, 388 aa, Clostridium carboxidivorans; identical to SEQ ID NO: 216

SEQ ID NO: 391 - protein, 388 aa, Clostridium beijerinckii
MARFTLPRDLYHGEGALEVLKTLKGKKAFVVVGGGSMKRFGFLKQVEDYLTEAGMEVELFEGVEPDPSVETVMKGAEAMRNFEPDWIVAMGGGSPIDAAKAMWIFYEYPDFTFEQAVVPFGLPELRQKAKFVAIPSTSGTATEVTAFSVITNYTEKIKYPLADFNITPDIAIVDPVLAQTMPKTLTAHTGMDALTHAIEAYTASLRSNFSDPLAIKALQMVQENLIKSFEGDKEARNLMHEAQCLAGMAFSNALLGIVHSMAHKVGAVFHIPHGCANAIFLPYVIQYNRTKCEDRYGDIARALKLKGNNDAELTDSLIELINGLNDKLEIPHSMKAYGVTEEDFKANLSFIAHNAVLDACTGSNPREIDDATMEKLFECTYYGTKVNL

SEQ ID NO: 392 - protein, 388 aa, Clostridium carboxidivorans
MSRFTLPRDLYFGDNSLAELKNLKGKKAVVVVGGGSMKKFGFLEKVENYLKEAGMEVKLIEGVEPDPSVETVFNGAQVMRDFEPDWIVSIGGGSPIDAAKAMWIFYEYPDFTFEQAVIPFGIPELRQKARFVAIPSTSGTATEVTAFSVITDYKARIKYPLADFNLTPDVAIIDPALAQTMPPKLTAHTGMDALTHAIEAYVASARSHFSDPLAMQAIVMVREHLIKSYSGDKEARNEMHIAQCLAGMAFSNALLGIVHSMAHKSGAVFHIPHGCANAIYLPYVIQFNRKASESRFAVIAKTLGLDGNTDADLTDSLVAMIRDMNKQLDIPLTLKDYGITEEDFNENVDFISKNALTDACTGSNPREIDFDQMKKLFQCTFTGEDCTF

SEQ ID NO: 393 - protein, 388 aa, Clostridium sp.
MMRFTLPRDIYYGKGCLEQLKTLKGQRAVLALGGGSMKKFGFVDKALEYLKEAGIEVKLIEGIEPDPSVETVLKGAEVMRDFKPDWIIAMGGGSPIDAAKAMWVFYEHPEKTFDDIKDPFTIPELRSKAKFLAIPSTSGTATEVTAFSVITDYKTEIKYPLADFNITPDVAIVDSELAETMPAKLTAHTGMDALTHAIEAYVATLHSPFTDPLALQAIEMINEYLLKSYDGDKDAREQMHYAQCLAGMAFSNALLGITHSMAHKTGAVFHIPHGCANAIYLPYVIDFNKKAALDRYAKIAKRLGLSGTSDDELVDSLTSLIKELNKKMAIPSTLKEYGIDEEEFKAKVDLISERAIGDACTGSNPRQINKDEMKKIFECVYYGNKVEF

SEQ ID NO: 394 - protein, 396 aa, Ruminococcus torques
MSEMSRFCLPRDIYHGKGCLEELKNLKGKKAILVVGGGSMKRQGFLDRAVGYLKEAGMEVQLFEGVEPDPSVETVMKGAEAMRAFEPDWIVSMGGGSPIDAAKAMWAFYEYPDTTFEELCTPFNFPELRQKAKFCAIPSTSGTATEVTAFSVITNYQTGVKYPLADFNITPDVAIVDPDLVAGLPVKQVAYTGMDALTHAIEAYVSTLNGPFTDPLALQAIEMVLDYLPASYNCNMDAREQMHYAQCLAGMAFSNALLGIVHSMAHKTGAAFSTGHIPHGCANAIYLPYVIQYNAKDSVAAKRYAEIARRMGLEGNSEKALINSLVAKIDEFNAKLNIPKTLKDFGINEEEFKEKIAKISELAVGDACTGSNPRAIDPAAMEKLFTCTYYGTEVDF

SEQ ID NO: 395 - protein, 396 aa, Clostridium saccharolyticum
MARFTLPRDLYHGKGALEELKNIKGKKAIVVVGGGSMKRFGFLDRVEACLKEAGMEVKLFEGVEPDPSVDTVMKGAEIMREFEPDWIVAIGGGSPIDAAKAMWAFYEYPETSFEDLCIPFNFPTLRTKARFCAIPSTSGTATEVTAFSVITDYKKGIKYPLADFNITPDIAIVDPDLAETMPQKLTAHTGMDAMTHAVEAYVSTLHCDYTDPLALHAIKMIHNDLIDSFNGDKEARARMHNAQCLAGMAFSNALLGIVHSMAHKTGAAYSGGHIVHGCANAMYLPKVIKFNSKAPEAAKRYAEIARFIGLQGGDENELVDALITEIRYMNKKLDIPTCIKEYEGGIIDEAEFNEKLVSVAELAVGDACTGSNPRPITPAEMEKLLTCCYYDKEVDF

SEQ ID NO: 396 - protein, 388 aa, Clostridium ljungdahlii
MERFTLPRDIYFGEDALGALKTLKGKKAVVVVGGGSMKRFGFLDKVEEYLKEANIEVKLIEGVEPDPSVETVMKGAKIMTEFGPDWIVAIGGGSPIDAAKAMWLFYEYPDFTFKQAIVPFGLPELRQKAKFVAIASTSGTATEVTSFSVITDYKAKIKYPLADFNLTPDIAIVDPALAQTMPPKLTAHTGMDALTHALEAYVASARSDISDPLAIHSIIMTRDNLLKSYKGDKDARNKMHISQCLAGMAFSNALLGITHSLAHKTGAVWHIPHGCANAIYLPYVLDFNKKACSDRYANIAKILGLKGTTEDELVDSLVKMVQDMDKELNIPLTLKDYGISKDDFNSNVDFIAKNALLDACTGANPRPIDFDQMKKILQCIYDGKKVTF

SEQ ID NO: 397 - protein, 388 aa, Clostridium butyricum
MARFTLPRDLYHGEGALEALKTLKGKKAFVVVGGGSMKRFGFLQKVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYTEKIKYPLADFNLTPDVAIVDPALAQTMPAKLVAHTGMDALTHAIEAYTASLRSNFSDPLAIKAIEMVNENLVKSFEGDKVARDLMHEAQCLAGMSFSNALLGIVHSMAHKVGAVFHIPHGCANAIFLPYVIQYNRKSCEDRYADIARALKLEGNTDAELTDSLIKLINEFNDKLSIPHSMKEYGVEEAEFKANLEFISHNAVVDACTGSNPREIDDATMAKLFECTYYGTEVNL

SEQ ID NO: 398 - protein, 388 aa, Clostridium perfringens
MARFTLPRDIYHGKDSLKVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACEDRYANIARHIGLKGESERELTDALIDLINKFNKELNIPSSMKEYGIEEDDFKANLKFIAHNAVLDPCTGSNPREIDDETMEKLYTCAYYGSDVDF

SEQ ID NO: 399 - protein, 388 aa, Clostridium perfringens
MARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIIPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACENRYANIARHIGLKGESERELTDDLIDLINKFNKELNIPSSMKEYGIDENEFKANLKFIAHNAVLDPCTGSNPREINDETMEKLYTCAYYGSDVDF

SEQ ID NO: 400 - protein, 388 aa, Clostridium beijerinckii; identical to SEQ ID NO: 219

SEQ ID NO: 401 - protein, 388 aa, Clostridium saccharoperbutylacetonicum
MMRFTLPRDIYYGKGSLEQLKTLKGKKAVLVLGGGSMKKFGFVDKALEYLKEAGIEVKLIEGVEPDPSVETVFKGAETMREFGPDWIISMGGGSPIDAAKAMWIFYEYPDFTFEKAVVPFGLPELRQKAKFIAIPSTSGTATEVTAFSVITDYKTEIKYPLADFNITPDIAIVDSELAETMPATLTAHTGMDALTHAIEAYVATLHSPFTDPLALQAIEMIRDFLLKSYEGDKDAREQMHYSQCLAGMAFSNALLGITHSMAHKTGAVFHIPHGCANAIYLPYVIDFNKKTALDRYAYIAKRLGLSGTTDDELVDSLTNLIKEFNKKMSIPLTLKEYGIDEEVFKAKVDMISERAIADACTGSNPRQLNKDEMKKIFECIYYGNKVDF

SEQ ID NO: 402 - protein, 393 aa, Bacteroides capillosus; identical to SEQ ID NO: 220

SEQ ID NO: 403 - protein, 446 aa, Ruminococcus lactaris
MQKEVLCKVTIRQLCFTWNLYKISKNRVAFLRAERYNIPVKKITILHKKERFVMSRFCLPRDIYHGKGCLEELKNLKGKKACLVVGGGSMKRQGFLDRAVNYLKEGGMEVKLIEGVEPDPSVETVMKGAEVMREFEPDWIVAMGGGSPIDAAKAMWVFYEYPEVSFEDIITPFSFPELRQKAKFAAIPSTSGTATEVTAFSVITNYQTGVKYPLADFNITPDVAIVDPDLVSGLPVKQVAYTGMDALTHAIEAYVSTLNGPFTDPLALQAIEMVLDYLPASYNCDMVAREQMHYAQCLAGMAFSNALLGIVHSMAHKTGAAFSTGHIPHGCANAIYLPYVIQYNAKDPVAAKRYAEIARRMGLPGTSEKALINSLIEKIDDFNVRLNIPKTLKDFGINEDEFKEKVDKIAELAVGDACTGSNPRAIDPAAMAKLLTCTYYGTEVDF

SEQ ID NO: 404 - protein, 395 aa, Clostridium clostridioforme
MRFTLPRDLYHGKDALEALKTLTGKKAIVVVGGGSMKRFGFLDKVVDYLKEAGMEVKLFEGVEPDPSVDTVLKGAAAMQEFEPDWIVAVGGGSPIDAAKAMWAFYEYPDTSFEDLITPFSFPTLRTKAKFCAISSTSGTATEVTAFSVITDYKKGIKYPLADFNITPDVAIVDPALAETMPGKLTAHTGMDAMTHAIEAYVSTLHCEYTDPLALHAIEMINEYLIPSYNGDMEARDKMHDAQCLAGMAFSNALLGIVHSMAHKTGAAYSGGHIVHGCANAMYLPKVIKFNSKEPEAAARYAKIAKFISLPGTTEEELTDALIARLLEMNKALDIPACIKDYEGGIIDEKEFMDKLPKVAELAVGDACTGSNPRSITPRVMEQLLKCCYYDEEVDF

SEQ ID NO: 405 - protein, 393 aa, Clostridium nexile
MSRFCLPRDIYHGKGCLEELKNLKGKKAILVVGGGSMKRQGFLDKAVNYLKEAGMEVQLFEGVEPDPSVETVMKGAEAMRAFEPDWIVAMGGGSPIDAAKAMWAFYEYPDVTFEDLCIPFNFPELRQKAKFAAIPSTSGTATEVTAFSVITDYAKGIKYPLADFNITPDVAIVDSELVEGLPAHQVAYTGMDALTHAIEAYVSTLNCAYTDPLAIQAIEMVFDYLPASYKGNMDARAHMHDAQCLAGMAFSNALLGIVHSMAHKTGAAFSTGHITHGLANAMYLPYVIKYNAKDPVAAKRYAEIARRVGLEGASEKALINSLCKKIDDFNVILGIPATLKEFGIKEDEFKEKIASIAELAVGDACTGSNPRAIDPATMERLFTCVYYGTEVDF

SEQ ID NO: 406 - protein, 389 aa, Clostridium tetani; identical to SEQ ID NO: 211

SEQ ID NO: 407 - protein, 388 aa, Clostridium sporogenes
MERFTLPRDLYFGEGSLETLKTLKGKKAVVVVGGGSMKRFGFLDKVESYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMKAIVMVKEYLVKSYNGDKEARGQMHLAQCLAGMAFSNALLGITHSMAHKTGAVFHIPHGCANAIFLPYVIQYNAKSCGERYATIAKNLGLAGENQDELVKALIEMIREMNKTMNIPLNLKEYGITEEEFKENVKYISHNSVLDACTGSNPREIDDETMEKLFACTYYGQDVEF

SEQ ID NO: 408 - protein, 388 aa, Clostridium beijerinckii
MARFTLPRDLYHGEGALEVLKTLKGKKAFVVVGGGSMKRFGFLKQVEDYLTEAGMEVELFEGVEPDPSVETVMKGAEAMRNFEPDWIVAMGGGSPIDAAKAMWIFYEYPDFTFEQAVVPFGLPELRQKAKFVAIPSTSGTATEVTAFSVITNYTEKIKYPLADFNITPDIAIVDPVLAQTMPKTLTAHTGMDALTHAIEAYTASLRSNFSDPLAIKALQMVQENLIKSFEGDKEARNLMHEAQCLAGMAFSNALLGIVHSMAHKVGAVFHIPHGCANAIFLPYVIQYNRTKCEDRYADIARALKLEGNTDSELTDSLIGMINKMNSDLNIPHSMKEYGVTEEDFKANLSFIAHNAVLDACTGSNPREIDDATMEKLFECTYYGTKVEL

SEQ ID NO: 409 - protein, 388 aa, Clostridium botulinum
MARFTLPRDLYHGEGSLETLKTLKGKKAFVVVGGGSMKRFGFLQKVEDYLKEAGMEVQLFEGVEPDPSVETVMKGAEAMRNFEPDWIVAMGGGSPIDAAKAMWIFYEYPDFTFEQAVVPFGLPDLRQKAKFVAIPSTSGTATEVTAFSVITDYKAKIKYPLADFNITPDIAIVDPELAQTMPAKLVAHTGMDALTHAIEAYTASLRSNFSDPLAIKAIEMVNENLVKSFEGDKEARNLMHEAQCLAGMAFSNALLGIVHSMAHKVGAVFHIPHGCANAIFLPYVIEYNRAECEDRYADIARALKLEGNTDAELTDSLIKLINDFNDKLNIPHSMKEYGVEEADFKANVEFIAHNAVLDACTGSSPRAIDYKTMEKLLGCTFYGTKVNF

SEQ ID NO: 410 - protein, 388 aa, Clostridium botulinum
MERFTLPRDLYFGEGSLEALKTLKGKKAVVVVGGGSMKRFGFLDKVQSYLNEAGIEVKLIEGVEPDPSVETVMNGAAVMREFEPDLIVSIGGGSPIDAAKAMWIFYEYPDFTFEQAVVPFGIPELRQKARFVAIPSTSGTATEVTAFSVITDYKKKIKYPLADFNLTPDIAIVDPDLAQTMPAKLTAHTGMDALTHAIEAYVAGLRSVFSDPLAMQAIVMVKEYLVKSYNGNKEARGQMHLAQCLAGMAFSNALLGITHSMAHKTGAVFHIPHGCANAIFLPYVIQYNFKSCGERYATIAKKLGLAGENQDELVKSLIEMIREMNKTMNIPLNLKEYGITEEDFKENVKYISHNAVLDACTGSNPREINDETMEKLFACTYYGEDVTF

SEQ ID NO: 411 - protein, 393 aa, Clostridiales sp.
  Butyrate-producing bacterium SS3/4
MARFTLPRDIYHGKGCLEELKNLKGKKAFLVVGGGSMKRQGFLDKAVHYLKDGGMEVEVFEGVEPDPSVETVMRGAEAMRKFEPDWIVSMGGGSPIDAAKAMWAFYEYPETTFEDLITPFSFPELRQKARFAAIPSTSGTATEVTAFSVITNYQTGVKYPLADFNITPDVAIVDPDLVMGLPVKQVAYTGMDALTHAIEAYVSTLNGPFTDPLALQAIEMVLEYLPASYNGNTHAREEMHYAQCLAGMAFSNALLGIVHSMAHKTGAAFSTGHIPHGCANAIYLPYVIQYNAKDTVAAERYAEIARRMGLEGRSRQALINSLCAKINEFNEKLNIPKTLKEFGINEDEFKEKVDRIAELAVGDACTGSNPREIDPANMAKLLTCTYYGTEVDF

SEQ ID NO: 412 - protein, 391 aa, Anaerostipes caccae; identical to SEQ ID NO: 213

SEQ ID NO: 413 - protein, 427 aa, Clostridium sp.
MKASAQTEACLQWGMRMSGDGPAGRVHPFMKEESEMARFTLPRDIYHGKGCLEELKNLKGKRAILVVGGGSMKRQGFLDKAVEYLKEAGMEVRVFEGVEPDPSVETVMKGAQVMREFEPDWIVSMGGGSPIDAAKAMWAFYEYPEVTFEELCTPFNFPELRTKAKFAAIPSTSGTATEVTAFSVITDYEKGIKYPLADFNITPDVAIVDPELVEGLPAKQVAYTGMDALTHAIEAYVSTLHCTFTDPLAIKAIQIVNSDLQKSYDGDMRSREEMHYGQCLAGMAFSNALLGIVHSMAHKTGAAFSTGHITHGLANAMYLPYVISYNAKEPEAAARYAEIANAIGITGTVEECIEGLRKKIRSMNDYMGIPNTLKEFGIEEKEFKEKLAAISENAVGDACTGSNPRTIDPKTMEKLFTCIYYGTEVDF

SEQ ID NO: 414 - protein, 411 aa, Clostridium sp.
  [Clostridium] cf. saccharolyticum K10
MSGDGPAGRVHPFMKEESEMARFTLPRDIYHGKGCLEELKNLKGKRAILVVGGGSMKRQGFLDKAVEYLKEAGMEVRVFEGVEPDPSVETVMKGAQVMREFEPDWIVSMGGGSPIDAAKAMWAFYEYPEVTFEELCTPFNFPELRTKAKFAAIPSTSGTATEVTAFSVITDYEKGIKYPLADFNITPDVAIVDPELVEGLPAKQVSYTGMDALTHAIEAYVSTLHCTFTDPLAIKAIQIVNSDLQKSYDGDMRSREEMHYGQCLAGMAFSNALLGIVHSMAHKTGAAFSTGHITHGLANAMYLPYVISYNAKEPEAAARYAEIANAIGITGTVEECIEGLRKKIRSMNDYMGIPNTLKEFGIEEKEFKEKLAAISENAVGDACTGSNPRTIDPKTMEKLFTCIYYGTEVDF

SEQ ID NO: 415 - protein, 438 aa, Clostridium asparagiforme
MYLPTIARPWYDVIVKEITKVTDLERTGDVTANKFCAEKERLTMRFTLPRDLYHGKDALEALKTLTGKKAIVVVGGGSMKRFGFLDKVVDYLKEAGMEVQLFEGVEPDPSVDTVMKGAEAMRQFGPDWIVAIGGGSPIDAAKAMWAFYEYPETTFEDLITPFSFPTLRTKAKFCAIPSTSGTATEVTAFSVITDYNKGIKYPLADFNITPDIAIVDPALAETMPKKLTAYTGMDAMTHAIEAYVSTLHCEYTDPLALHAIEMINEYLIPSYNGDMEARDKMHDAQCLAGMAFSNALLGIVHSMAHKTGAAYSGGHIVHGCANAMYLPKVIKFNAKEPEAAARYAKIARFIGLTGATDEELTTALIGRLLEMNKALEIPTCIKDYEGGIIDEKEFMDKLPKVAELAVGDACTGSNPRTINPDQMAKLLKCCFYDEEVDF

SEQ ID NO: 416 - protein, 388 aa, Clostridium beijerinckii
MARFTLPRDIYHGEGALEALKTLKGKKAFLVVGGGSMKRFGFLKQVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYSEKIKYPLADFNITPDIAIVDPALAQTMPKTLTAHTGMDALTHAIEAYTASLQSNFSDPLAIKAVEMVQENLIKSFEGDKEARNLMHEAQCLAGMAFSNALLGIVHSMAHKVGAVFHIPHGCANAIFLPYVIEYNRTKCENRYGDIARALKLKGNNDAELTDSLIELINGLNDKLEIPHSMKAYGVTEEDFKANLSFIAHNAVLDACTGSNPREIDDATMEKLFECTYYGTKVNL

SEQ ID NO: 417 - protein, 393 aa, Clostridium sp.
MSRFTLPRDIYHGKGCLEELKNLKGKKAILVVGGGSMKRQGFLDRAVDYLKEAGMEVQLFEGVEPDPSVETVMKGAEAMRAFEPDWIVAMGGGSPIDAAKAMWAFYEYPEVTFEDLCIPFNFPELRQKAKFAAIPSTSGTATEVTAFSVITNYQTGVKYPLADFNITPDVAIVDSELVEGLPAKQVAYTGMDALTHAIEAYVSTLNCAFTDPLAIQAIEMVFDYLPASYRGNMDARAEMHTAQCLAGMAFSNALLGIVHSMAHKTGAAFSTGHITHGCANAMYLPFVIKYNAKDPVAAKRYAEIARRVGLQGASEKALINSLCEKIDDFNVQLGIPKTLKEFGINEDEFKEKIARISELAVGDACTGSNPRSITPAEMERLFNCIYYGTEVDF

SEQ ID NO: 418 - protein, 405 aa, Butyrivibrio proteoclasticus; identical to SEQ ID NO: 212

SEQ ID NO: 419 - protein, 396 aa, Clostridium hathewayi
MARFTLPRDLYHGKGALEELKNLKGNKAIVVVGGGSMKRFGFLDRVIDYLKEAGLEVKLFEGVEPDPSVDTVMKGAEMMREFGPDWIVAIGGGSPIDAAKAMWAFYEYPDTTFEDLCIPFNFPTLRTKARFCAIPSTSGTATEVTAFSVITDYNKGIKYPLADFNITPDVAIVDPDLAETMPAKLTAFTGMDAMTHAIEAYVSTLHCDYTDPLALHAIKMIHNDLIDSYNGDMAARDRMHNAQCLAGMAFSNALLGIVHSMAHKTGAAYSGGHIVHGCANAMYLPKVIRFNAKEPEAAKRYAEIARFIDLKGSTDEELVAALIAELRGMNEKLNIPTCIKEYEGGIIDETEFNEKLPSVAELAVGDACTGSNPRPITPAEMEKLLTCCYYDKEVDF

SEQ ID NO: 420 - protein, 393 aa, Dorea formicigenerans
MARFTLPRDIYHGEGALEELKNLKGKKAIVVVGGGAMKRQGFLAKVEDYLKEAGMKVALFEGVEPDPSVETVMKGAKAMQEFEPDWIVAMGGGSPIDAAKAMWAFYEYPEITFEDLITPFSFPELRQKAKFAAIPSTSGTATEVTAFSVITDYAKGIKYPLADFNITPDVAIVDPALVAELPVNQVAYTGMDALTHAIEAYVSTLNCPYTDPLALKAIEMVFDYLPASYRCNMEARAKMHDAQCLAGMAFSNALLGIVHSMAHKTGAAFSTGHITHGLANAMYLPYVIKYNAKDPVAAKRYAEIARFVGLGGASEKALINSLCEKINEFNVILNIPATLKDFGIKEDEFKEKIATISENAVGDACTGSNPRTIDPATMERLFTCIYYGTEVDF

SEQ ID NO: 421 - protein, 388 aa, Clostridium sp.
MARFTLPRDLYHGEGSLEALKTLKGKKAFVVVGGGSMKRFGFLDKVETYLKEAGMEVELFEGVEPDPSVETVMSGAEAMRKFEPDWIVAMGGGSPIDAAKAMWIFYEYPDFTFEQAVIPFGLPELRQKAKFVAIPSTSGTATEVTAFSVITDYKAKIKYPLADFNITPDIAIVDPDLAQTMPAKLVAHTGMDALTHAIEAYTASLRSNFSDPLAMKAIEMVRENLVASYNGDKQARNLMHEAQCLAGMAFSNALLGIVHSMAHKTGAVFHIPHGCANAIFLPYVIQYNRTKCEERYADIARALKLKGETDAELTDSLIEMINDLNTELNIPHTVKEYGVTEEDFKANLEFISHNAVLDACTGSNPREIDDATMEKLFECTYYGTKVNF

SEQ ID NO: 422 - protein, 404 aa, Synergistes sp.
MARFTLPRDLYHGKGSLEALKTLKGTKAIVVVGGGSMKRFGFLDRVEQYLKEAGMEVRLFEGVEPDPSVETVMRGAAVMREFQPDWIVSIGGGSPIDAAKAMWAFYEYPDTTFEALCIPFNFPTLRQKAKFCAIPSTSGTATEVTAFSVITDYAKGIKYPLADFNITPDVAIVDPELAETMPKKLTAHTGMDAMTHAIEAYVSTLNCDYTDPLALHAIEMVSENLVKSYNGDMAARDRMHDAQCLAGMAFSNALLGIVHSMAHKTGAAYSGGHIVHGCANAMYLPKVIRFNAAEPAAAERYAKIAKYLHLEGKTTAELVEALVDHINGLNAQLDIPTRIKDYEGGIIDEKEFMEKLPKVAELAVGDACTGSNPRAITPKQMEELLKSCYFDKEAVRAAKSTQAA

SEQ ID NO: 423 - protein, 388 aa, Clostridium butyricum
MARFTLPRDLYHGEGALEALKTLKGKKAFVVVGGGSMKRFGFLQKVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYTEKIKYPLADFNLTPDVAIVDPALAQTMPAKLVAHTGMDALTHAIEAYTASLRSNFSDPLAIKAIEMVNENLVKSYKGDKVARDLMHEAQCLAGMSFSNALLGIVHSMAHKVGAVFHIPHGCANAIFLPYVIQYNRKSCEDRYADIARALKLEGNTDAELTDSLIKLINEFNDKLSIPHSMKEYGIEEAEFKANLEFIAHNAVLDACTGSNPREIDDATMAKLFECTYYGTEVNL

SEQ ID NO: 424 - protein, 393 aa, Lachnospiraceae bacterium
MARFTLPRDIYHGKGCLEELKNLKGKKAILVVGGGSMKRQGFLDKAVNYLKEAGMEVQLFEGVEPDPSVETVMKGAEAMRAFGPDWIVAMGGGSPIDAAKAMWAFYEYPDVTFEDLCIPFNFPELRQKAKFAAIPSTSGTATEVTAFSVITDYAKGIKYPLADFNITPDVAIVDSELVEALPARQVAYTGMDALTHAIEAYVSTLNCAYTDPLAIQAIEMVFDYLPASFKGNMEARAQMHNAQCLAGMAFSNALLGIVHSMAHKTGAAFSTGHITHGLANAMYLPYVIKYNAKDPVAAKRYAEIARRVGLAGASERALINSLCEKINEFNVILGIPATLKEFGIKEDEFKEKISEIAKNAVGDACTGSNPRAIDPETMERLFTCIYYGTEVDF

SEQ ID NO: 425 - protein, 388 aa, Clostridium butyricum; identical to SEQ ID NO: 217

SEQ ID NO: 426 - protein, 388 aa, Clostridium saccharobutylicum
MMRFTLPRDIYYGKGSLEQLKNLKGKKAMLVLGGGSMKRFGFVDKALGYLKEAGIEVKLIEGVEPDPSVETVFKGAELMRQFEPDWIIAMGGGSPIDAAKAMWIFYEHPEKTFDDIKDPFTVPELRNKAKFLAIPSTSGTATEVTAFSVITDYKTEIKYPLADFNITPDVAVVDSELAETMPPKLTAHTGMDALTHAIEAYVATLHSPFSDPLAMQAVEMINEYLLKSYEGDKEAREQMHYAQCLAGMAFSNALLGICHSMAHKTGAVFHIPHGCANAIYLPHVIKFNSKTSLERYAKIAKQISLPGNTNEELVDSLINLVKELNKKMQIPATLKEYGIDEQEFKDKVDLISERAIGDACTGSNPRQLNKDEMKKIFECVYYGTEVDF

SEQ ID NO: 427 - protein, 388 aa, Clostridium perfringens
MARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACENRYANIARHIGLKGESERELTDDLIDLINKFNKELNIPSSMKEYGIDENEFKANLKFIAHNAVLDPCTGSNPREINDETMEKLYTCAYYGSDVDF

SEQ ID NO: 428 - protein, 388 aa, Clostridium botulinum
MARFTLPRDIYFGSGCLDVLKTIKGKKAVIVIGGGSIKRSGFLDKIEGYLKEANIETKLIEGVEPDPSVETVMNGAAIMREFQPDLIIGVGGGSPIDAAKAMWIFYEYPDFTFEKAVIPFGIPELRQKAKFIAIPSTSGTASEVTAFSVITDYKAKIKYPLADFNLTPDIAIVDSDIAQTMPPKLTAHTGMDALTHAIEAYVAGARSAFSDPLAIQAIVMVRDNLVNSFKGDKEARDQMHIAQCLAGMSFSNALLGITHSMAHKIGAVFHIPHGCANAIFLPYVIEYNRKACEDRYATIARRLNLEGNNDSELVDSLINLINELNVKLNIPSTIKEWGVSEEEFKENVEFMAHNAVLDACTGANPRNIDDKTMMKLYSCAFYGEKVNF

SEQ ID NO: 429 - protein, 396 aa, Clostridium lentocellum
MARFTLPRDLYHGKGSINELKNLTGKKAIVVVGGGSMKRFGFLDQVVDNLKEAGMEVKLFENVEPDPSVETVMKGAEVMREFEPDWIVAIGGGSPIDAAKAMWVFYEYPETTFEAIIQPFSFPTLRQKAKFCAIPSTSGTATEVTAFSVITDYAKGIKYPLADFNITPDIAIVDPNLAETMPAQLTAHTGMDALTHAIEAYVSTCHSCFTDPLALKAIEMIFDDLQASYEGDMEAREQMHYAQCLAGMAFSNALLGIVHSMAHKTGAAYKNGHIVHGCANAMYLPQVIRFNAKDEVAAKRYADIAKFIDLEGDTTEGLVKALCDKIEAYNVALNIPKCIKDYENGMVPEDEFLEKLPEVAALAISDACTGSNPRIPDQKQMEELLKCCYYGTEVDF

SEQ ID NO: 430 - protein, 388 aa, Clostridium botulinum
MARFTLPRDIYFGAGCLDVLKTIKGKRAVIVIGGGSIKRSGFLDKIEGYLKEANIETRLIEGVEPDPSVETVMNGAKVMREFNPDLIIGIGGGSPIDAAKAMWIFYEYPEFTFEKAVVPFGLPDLRQKAKFIAIPSTSGTASEVTAFSVITDYKAKIKYPLADFNLTPDIAIVDSDIAQTMPPKLVAHTGMDALTHAIEAYVAGLRSAISDPLAIQAIVMVRDNLVKSFEGDKKARDEMHIAQCLAGMAFSNALLGITHSMAHKIGAVFHIPHGCANAIFLPYVIDYNRKVCEDRYATIARSLGLKGNTDKELVDSLIGLINELNVKLNIPSTIKEWGVSEEDFKSNVEFMAHNAVLDACTGANPREINDETMVKLYNCTFYGEKVNF

SEQ ID NO: 431 - protein, 388 aa, Clostridium perfringens
MARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIIPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVKMHLVNSYKGDMEARGEMHEAQCLAGMAFSNALLGIVHSMAHKVGAVFHIPHGCANAIFLPYVIKYNRKACENRYANIARHIGLKGESERELTDALIDLINKFNKELNIPSSMKAYGIEEDDFKANLKFIAHNAVLDPCTGSNPREIDDETMEKLYTCAYYGSDVDF

SEQ ID NO: 432 - protein, 428 aa, Clostridium sp.
MMYNVFVAKQSIEIGYSNVGYIRKGSISVIQVKEMLVMARFTLPRDLYFGENALETLKTIKGNKAVLCLGGGSMKRFGFVDKVVEYLKEAGIETKLIEGIEPDPSVETVMKGAKVMQEFEPDLIIAMGGGSPIDAAKAMWVFYEHPETTFDDIKDPFTIPPLRNKATFIAIPSTSGTATEVTAFSVITDYSTGIKYPLADFEITPDVAIVDPSLAETMPQTLTAHTGMDALTHAIEAYVAGLHSPFSDPLAIHAIEMIFDNLKASYEGDMQARGNMHIAQCLAGMAFSNALLGIVHSLAHKTGAVFNTGHIPHGCANAIYLPYVIQYNAKVCEDRFAMIARKLGLPGVTDKALTLSLIKAVEDLRTSLHIVSNLKDFGVNEDEFLEKKHMIAERAVGDACTGSNPRETSVEDMEKILECIYYGKDVTF

SEQ ID NO: 433 - protein, 388 aa, Clostridium sp.
MMRFTLPRDVYYGKGSLEQLKNLKGKKAVLVLGGGSMKKFGFVDKAVSYLNEAGIEVKLIEGVEPDPSVETVFKGAEVMREFNPDWIISMGGGSPIDAAKAMWIFYEYPDFTFEQAVVPFGLPELRQKAKFLAIPSTSGTATEVTAFSVITDYKTEIKYPLADFNITPDIAIVDSELAETMPPTLTAHTGMDALTHAIEAYVATLHSPFTDPLAIQAIEMINEYLAKSYEGDNEAREQMHYAQCLAGMAFSNALLGITHSMAHKTGAVFHIPHGCANAIYLPYVIDFNKKAASDRYAKIAKSLGLDGQTNDELIDSLTSLIQEFNKKMSIPLTLKEYGIDEEEFKAKVDLIAERAVGDACTGSNPRQINKDEMKKIFECVYYGNKVDF

SEQ ID NO: 434 - protein, 393 aa, Lachnospiraceae bacterium
MGRFTLPRDIYHGKGCLEELKNLKGKKAILVVGGGSMKRQGFLDKAVNYLKEAGMEVELFEGVEPDPSVETVMRGAEAMRKFEPDWIISMGGGSPIDAAKAMWAFYEYPDVTFEELCIPFNFPELRQKAKFCAIPSTSGTATEVTAFSVITNYETGVKYPLADFNITPDVAIVDSELVEGLPAKQVAYTGMDALTHAIEAYVSTLNCAYTDPLAIQAIEMVFDYLPASFRGNMDARAHMHDAQCLAGMAFSNALLGIVHSMAHKTGAAFSTGHITHGCANAMYLPYVIKYNAKDPVAAKRYAEIARKVGLPGASEKALINSLCEKIDDFNVQLNIPKTLKEFGINEDEFKEKIAKISELAVGDACTGSNPRAIEPATMEKLFTCIYYGTEVDF

SEQ ID NO: 435 - protein, 388 aa, Clostridium botulinum
MARFTLPRDIYFGAGCLDVLKTIKGKKAVIVIGGGSIKRSGFLDKIERYLKEANIETRLIEGVEPDPSVETVMNGASVMREFEPDLIIGVGGGSPIDAAKAMWIFYEYPDFTFEKAVIPFGIPELRQKAKFIAIPSTSGTASEVTAFSVITDYKAKIKYPLADFNLTPDIAIVDSDIAQTMPPKLTAHTGMDALTHAIEAYVAGARSAFSDPLAIQAIVMVRDNLVNSFKGDREARDQMHIAQCLAGMSFSNALLGITHSMAHKIGAVFHIPHGCANAIFLPYVIEYNRKACEDRYATIARRLELKGNTDSELVDSLINLINELNVKLNIPSTIKEWGVSEEDFKKNVEFMAHNAVLDACTGANPREIDDETMTKLYNCTFYGEKVDF

SEQ ID NO: 436 - protein, 395 aa, Clostridium clostridioforme
MRFTLPRDLYHGKDALEALKTLAGKKAIVVVGGGSMKRFGFLDKVIDYLKEAGMEVQLFEGVEPDPSVDTVLKGAAAMQEFEPDWIVAVGGGSPIDAAKAMWAFYEYPDTSFEDLITPFSFPTLRTKAKFCAISSTSGTATEVTAFSVITDYKKGIKYPLADFNITPDVAIVDPALAETMPKKLTAHTGMDAMTHAIEAYVSTLHCEYTDPLALHAIEMINEYLIPSYNGDMEARDKMHDAQCLAGMAFSNALLGIVHSMAHKTGAAYSGGHIVHGCANAMYLPKVIKFNSKEPEAAARYAKIAKFINLPGTTDEELTDALIARLLEMNKALDIPACIKDYEGGIIDEKEFMDKLPKVAELAVGDACTGSNPRTITPEVMEQLLKCCYYDEEVDF

SEQ ID NO: 437 - protein, 393 aa, Dorea longicatena
MARFTLPRDVYHGKGCLSELKNLKGKKAVLVVGGGSMKRQGFLDKAVNYLKEGGMEVKLIEGVEPDPSVETVMKGAKVMQEFEPDWIVAMGGGSPIDAAKAMWVFYEYPDETFENIITPFSFPELRQKAKFAAIPSTSGTATEVTAFSVITDYNTGIKYPLADFNITPDVAIVDPELVEGLPQKQVAYTGMDALTHAIEAYVSTLNCPFTDPLALQAIEMVLDYLPASYNLNMEAREQMHYAQCLAGMAFSNALLGIVHSMAHKTGAAFSTGHIPHGCANAIYLPYVIKYNAKDKVAASRYAEIARRMGLPGTSEKALINSLCAKIDEFNAKMNIPKTLKEFGINEEEFKEKLDKIAELAVGDACTGSNPRAIDPATMAKLFTCTYYGTEVDF

SEQ ID NO: 438 - protein, 391 aa, Anaerostipes sp.
MGRFTLPRDLYFGKGSLETLKTLDGKKAVLVLGGGSMKRFGFVDQVVDYLKEAGIETKLIEGVEPDPSVETVFKGAEVMRDFEPDWIIAMGGGSPIDAAKAMWIFYEHPETTFDDVKDPFTVPPLRNKAKFLAIPSTSGTATEVTAFAVITDYSSGIKYPLADFEITPDIAIVDPALAETMPPKLTSYTGMDALTHAIEAYVAGLHSPFSDPLALEAIEMVFDNLKASYEGDMTARENMHYAQCLAGMSFSNALLGIVHSLAHKTGAVFDTGHITHGCANAIYLPYVIQFNAKVCEERYAAIARRIGLPGNSDKALTLSLIEAIREMNKKLNIVSNLKDFGINEEEFNQKKRMIAERAVADACTGSNPRETSVDDMEKVLECIYYGKDVTF

SEQ ID NO: 439 - protein, 468 aa, Clostridium saccharoperbutylacetonicum; identical to SEQ ID NO: 237

SEQ ID NO: 440 - protein, 468 aa, Clostridium saccharoperbutylacetonicum
MIKDTLVSITKDLKLKTNVENANLKNYKDDSSCFGVFENVENAISNAVHAQKILSLHYTKEQREKIITEIRKAALENKEILATMILEETHMGRYEDKILKHELVAKYTPGTEDLTTTAWSGDNGLTVVEMSPYGVIGAITPSTNPTETVICNSIGMIAAGNTVVFNGHPGAKKCVAFAVEMINKAIISCGGPENLVTTIKNPTMDSLDAIIKHPSIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYSINKKWVGKDAKLFLDEIDVESPSSVKCIICEVSARHPFVMTELMMPILPIVRVKDIDEAIEYAKIAEQNRKHSAYIYSKNIDNLNRFEREIDTTIFVKNAKSFAGVGYEAEGFTTFTIAGSTGEGITSARNFTRQRRCVLAG

SEQ ID NO: 441 - protein, 468 aa, Clostridium beijerinckii; identical to SEQ ID NO: 70

SEQ ID NO: 442 - protein, 468 aa, Clostridium beijerinckii; identical to SEQ ID NO: 239

SEQ ID NO: 443 - protein, 468 aa, Clostridium sp.
MNKDTTISETENLKFKTNIKNADLKNYENSTSYSGVFEDVEVAINKAITAQKEFSLYYTKEQREKILTEIRKATLKNKKILAKMILDETHMGRYEDKILKHELVAKYTPGIEDLTTTAWSGDNGLTVVEMAPYGVIGAITPSTNPTETVICNSIGMIAAGNAVVFNGHPSAKKCVAFAVDMINKAIVSCGGPKNLITAVKNPTMESLDAIIKHPEIKLLCGTGGPGMVKTLLNSGKKAIGAGAGNPPVIVDDTADIEKAGKNIIEGCSFDNNLPCIAEKEVFVFDNVADNLIDNMLKNNAVIINKDKITKLLNLILQKNNETQEYNINKKWVGKDAKLFLNEIDVEAPSSVRCIICEVEPDHPFVMTELMMPILPIVRVKNIDDAIQYAKIAEQSRKHSAYIYSKNIDNLNRFEKEIDTTIFVKNAKSFAGVGYNAEGFTTFTIAGCTGEGITSARNFTRQRRCVLAG

SEQ ID NO: 444 - protein, 469 aa, Clostridium saccharobutylicum
MNNNLFVSPETKDLKLRTNVENLKFKGCEGGSTYIGVFENAETAIDEAVNAQKRLSLYYTKEQREKIITEIRKVTLKNKEILAQMILEETHMGRYEDKILKHELVAKYTPGTEDLATTAWSGDNGLTVVEMSPYGVIGAITPSTNPTETIICNSIGMIASGNAVVFNGHPGAKKCVAFAVDMINRAIISCGGPRNLVTAIKNPTMESLDAIIKHPAIKLLCGTGGPGMVKTLLSSGKKSIGAGAGNPPVIVDDTADIEKAGKSIIEGCSFDNNLPCIAEKEVFVFENVADDLIKNMLKNNAVIINKDQVSRLVNLVLQKNNETSEYTINKKWVGKDAKLFLDEIDVESSSDVRCIICEVDADHPFVMTELMMPILPIVRVKDIDEAIKYAKIAEQNRKHSAYIYSKNIENLNRFEKEIDTTIFVKNAKSFAGVGYGAEGFTTFTIAGCTGEGITSARNFTRQRRCVFVG

SEQ ID NO: 445 - protein, 467 aa, Clostridium botulinum; identical to SEQ ID NO: 235

SEQ ID NO: 446 - protein, 527 aa, Caldalkalibacillus thermarum; identical to SEQ ID NO: 240

SEQ ID NO: 447 - protein, 480 aa, Pelosinus fermentans
MSIDQALIEKITLEILTKMQTGAKAAPAGYGDGIFETVDEAVAAARKAYQELKTLSLEKREVLIKAMRDVAYENATILAQMAVDESGMGRVSDKIIKNQVAALKTPGTEDLTTQAWSGDNGLTLIEMGPYGVIGAITPTTNPTETVICNGIGMIAAGNTVFFSPHPTAKNTSMKIITLLNQAIVKAGGPNNLLTSVANPSIKAANEMMKHPGINMLVATGGPGVVKAVLSSGKKAIGAGAGNPPVIVDETADIEKAARDIVAGCSFDNNLPCIAEKEVIAIGSIADRLITYMQKYGAYLISGSNIDRLLDVIMTVQEEKIAEGCTDKPKRSYGINKDYVGKDAKYLLSKIGIDVPDSVRVVLCETPADHPFVIEELMMPVLPVVQVKDIDEAIEVAVRVEHGNRHTAAMHSKNVDHLTRFARAVETTIFVKNAPSYAGIGVGGEGFTSFTLAGPTGEGITSPRSFTRQRRCVLVDAFSIV

SEQ ID NO: 448 - protein, 479 aa, Thermoanaerobacterium thermosaccharolyticum
MEINDNMISEIIERVLKEVQKKSINDRYQNGIYDRMEDAIEAAYEAQKKLMKMSIEQRERLISAMRKAILDNAKSCAKLSVEETGMGRVDHKYLKLKLVAEKTPGTEVLTTKAYSGDKGLTLVEMAPFGVIGSITPSTNPAETVCCNSIGMIAAGNTVVFSPHPGAIKSSLMAVEFLNKAIIEAGGPENLITSVRKPSIEFTDVMINHPKINLLVATGGPAIVKKVLSSGKKAIGAGAGNPPCVVDETADIKKAARDIILGCTFDNNLPCIAEKEVIAVESIYEELIENMKKNGAYEITDDEAEKLADIVLTKKEELKAEGCSINRPKFEYSVNKKWVGKDAKVLLEQIGINVGDDIVCIIYRCDKQHPFVQEELMMPILPIVKVKNIDEAINVAVEVEHGNHHTAEMHSKNIDNLTRFAKAINTTIFVKNAPSYAGIGFGGEGYTTFTIAGPTGEGLTCAATFTRQRRCVMVDSFRIV

SEQ ID NO: 449 - protein, 480 aa, Pelosinus fermentans; identical to SEQ ID NO: 238

SEQ ID NO: 450 - protein, 479 aa, Desulfosporosinus sp.
MSVDQALIRKITSEILAKMQNRTVSACQDCNGIFTTVDEAVAAARIAYQELRTLSLEKREELIKAMRNVALENATMLAEMAVKESGMGRVEDKIIKHKLVAVKTPGTEDLRTEAWSGDSGLTLVEMGPYGVIGAITPTTNPVATIICNGIGMIAAGNAVFFSPHPTAKNTSIKTITLLNEAIVKAGGPMNLLTSVADPSISAANAMMKHAGINLLVATGGPGVVKAVLSSGKKAIGAGAGNPPVIVDETADIEKAARDIIAGCSFDNNLPCIAEKEVIAVGCIADRLISNMQKYGAYLISGSKIDQMLDVVMTATEEKMAEGCTAKPIKRYGINKDFVGKDAKYILTQIGLDVPDTIKVILCETPADHPFVIEELMMPILPVVQVKDIDAAIELAVKVEHGNRHTAMMHSKNVDNMTRFAKAIETTIFVKNAPSYAGIGVGGEGFCTFTIAGPTGEGLTTARSFTRQRRCVLVDSFSII

SEQ ID NO: 451 - protein, 482 aa, Clostridium methylpentosum
MEITPNQIDQIVANVMAQLGGSAAPAASYDSTQYSGRKYIGIYATMTEAIDAVADAYKVLRSMTVDQREKIIEKIREFTRAEAEIMAKMGVEETGMGKVEHKTLKHHLVADKTPGTEDIQTEAMSGDGGLTLLEMAPFGIIGAISPSTNPSETVLCNSMGMIAGANAVVFNPHPSAICTSNYAVDLVNRASLAAGGPANLCCSVVKPTMQSADDMVKDPRVKMLVCTGGPGVVRAMLSSGKKAIGAGAGNPPVIVDDTADIRKAAKDIIDGCTFDNNLPCIAEKEVFAFSNIADELMYYMQQNGAYFISGEMADRLAKIVLVEKKNEKTGKISYSVSRDWVGRDAKKFLAALDIEVGDDVRCVICETDENHLFVQTELMMPILPIVRVNNIDEAVRMAVRAEHGNRHTAHMHSKNIDNLTKFARAVETTIFVKNAPSYAGIGFGSEGHTTFTIAGPTGEGLTSARSFTRKRRCVMSDSFNIV

SEQ ID NO: 452 - protein, 467 aa, Thermoanaerobacterium saccharolyticum
MKVKEEDIEAIVKKVLSEFNFEKNTKSFRDFGVFQDMNDAIRAAKDAQKKLRNMSMESREKIIQNIRKKIMENKKILAEMGVSETGMGKVEHKIIKHELVALKTPGTEDIVTTAWSGDKGLTLVEMGPFGVIGTITPSTNPSETVLCNSIGMIAAGNSVVFNPHPGAVNVSNYAVKLVNEAVMEAGGPENLVASVEKPTLETGNIMFKSPDVSLLVATGGPGVVTSVLSSGKRAIGAGAGNPPVVVDETADIKKAAKDIVDGATFDNNLPCIAEKEVVSVDKITDELIYYMQQNGCYKIEGREIEKLIELVLDHKGGKITLNRKWVGKDAHLILKAIGIDADESVRCIIFEAEKDNPLVVEELMMPILGIVRAKNVDEAIMIATELEHGNRHSAHMHSKNVDNLTKFGKIIDTAIFVKNAPSYAALGYGGEGYCTFTIASRTGEGLTSARTFTKSRRCVLADGLSIR

SEQ ID NO: 453 - protein, 467 aa, Thermoanaerobacterium xylanolyticum
MKVKEEDIEAIVKKVLSEFNLEKTTSKYGDVGIFQDMNDAISAAKDAQKKLRNMPMESREKIIQNIRKKIMENKKILAEMGVRETGMGRVEHKIVKHELVALKTPGTEDITTTAWSGDKGLTLVEMGPFGVIGAITPSTNPSETVLCNSIGMIAAGNSVVFNPHPGAVNVSNYAVKLVNEAAMEAGGPENLVVSVEKPTLETGNVMFKSSDVSLLVATGGPGVVTAVLSSGKRAIGAGAGNPPVVVDETADIKKAAKDIIDGATFDNNLPCIAEKEVVSVDKITDELIYYMQKNGCYKIEGREIEKLIELVLDHEGGKTTLNRKWVGKDAHLILKAIGIDADESVRCIIFEAEKDNPLVVEELMMPILGIVRAKNVDEAIMIATELEHGNRHSAHMHSKNIDNLTKFGKIIDTAIFVKNAPSYAALGYGGEGYCTFTIASRTGEGLTSARTFTKSRRCVLADGLSIR

SEQ ID NO: 454 - protein, 477 aa, Acetonema longum
MVDQTLIEQITRAVLTQMKAGKDAAVSGDGIFATVDQAVAAARQAYQELRLLTLEKRETLIRAIRDAAFANAAVIAQMAVQESGMGRVEDKILKNQLAARKTPGTEDLTSRAWSGDHGLTLVEMAPYGVIGAITPTTNPSETVICNSIGMIAAGNSIVFSPHPTAQNTSLTTIRLLNEAIVKAGGPDNLLTAVAEPSIEAANAMMRHPGIQMLVATGGPAVVKAVLSSGKKAIGAGAGNPPAVVDETADIAKAAKDIVAGCSFDNNLPCIAEKEIIAVGRIADELISYLQKYGAYLISGRDIERLMEVVLTERTEEMAPGCVGKPRRVYGVNKDYIGKDAKFILSKINIQAPDHIRVILCETPADHPFVLEELMMPVLPLVSVRDIDAAIDLAVKVEHGNRHTAVMHSKNVDYMTRLAKAIETTIFVKNAPSYAGIGVGGEGFTTFTIAGPTGEGLTSARSFTRQRRCALVDAFSIV

SEQ ID NO: 455 - protein, 465 aa, Geobacillus thermoglucosidans
MSVDAQKIEKLVRKILEEMEEKKKPAETECEWGIFDHMNQAIEAAEIAQKELVQLSLGQRGKLIEAIRKAAKENAEKFARMAVDETGMGKYEDKIVKNLLAAEKTPGIEDLRTEVFSGDDGLTLVELSPYGVIGAITPTTNPTETIICNSIGMIAAGNAVVFSPHPRAKNTSLYAIKIFNQAIVEAGGPKNLITTVANPSIEQAEIMMKHKTIKMLVATGGPGVVKAVLSSGKKAIGAGAGNPPVVVDETADIEKAAKDIIAGCSFDNNLPCVAEKEVIAVESIADRLIDYMKKHGAYEITNKEQIQQLTDLVVENGHANKEFVGKDAAYILKHIGINVPPDIRVAIMEVDGKHPLVTVELMMPILPIVRVKNVDQAIELAVEVEHGFRHTAIMHSKNVDHLTKFAKAIQTTIFVKNAPSYAGIGVGGEGYATFTIAGPTGEGLTSAKDFARKRKCVLVDALSIR

SEQ ID NO: 456 - protein, 463 aa, Geobacillus sp.
MDAQKIEKLVRKILEEMEEKKKPAETECEWGIFDHMNQAIEAAEIAQKELVQLSLGQRGKLIEAIRKAAKENAEKFARMAVDETGMGKYEDKIVKNLLAAEKTPGIEDLRTEVFSGDDGLTLVELSPYGVIGAITPTTNPTETIICNSIGMIAAGNAVVFSPHPRAKNTSLYAIKIFNQAIVEAGGPKNLITTVANPSIEQAEIMMKHKTIKMLVATGGPGVVKAVLSSGKKAIGAGAGNPPVVVDETADIEKAAKDIIAGCSFDNNLPCVAEKEVIAVESIADRLIDYMKKHGAYEITNKEQIQQLTDLVVENGHANKEFVGKDAAYILKHIGINVPPDTRVAIMEVDGKHPLVTVELMMPILPIVRVKNVDQAIELAVEVEHGFRHTAIMHSKNVDHLTKFAKAIQTTIFVKNAPSYAGIGVGGEGYATFTIAGPTGEGLTSAKDFARKRKCVLVDALSIR

SEQ ID NO: 457 - protein, 463 aa, Geobacillus thermoglucosidasius
MDAQKIEKLVRKILEEMEEKKKPAETECEWGIFDHMNQAIEAAEIAQKEFVQLSLGQRGKLIEAIRKAAKENAEKFARMAVDETGMGKYEDKIVKNLLAAEKTPGIEDLRTEVFSGDDGLTLVELSPYGVIGAITPTTNPTETIICNSIGMIAAGNAVVFSPHPRAKNTSLYAIKIFNQAIVEAGGPKNLITTVANPSIEQAEIMMKHKTIKMLVATGGPGVVKAVLSSGKKAIGAGAGNPPVVVDETADIEKAAKDIIAGCSFDNNLPCVAEKEVIAVESIADRLIDYMKKHGAYEITNKEQIQQLTDLVVENGHANKEFVGKDAAYILKHIGINVPPDIRVAIMEVDGKHPLVTVELMMPILPIVRVKNVDQAIELAVEVEHGFRHTAIMHSKNVDHLTKFAKAIQTTIFVKNAPSYAGIGVGGEGYATFTIAGPTGEGLTSAKDFARKRKCVLVDALSIR

SEQ ID NO: 458 - protein, 463 aa, Bacillus azotoformans
MAVEAKAIEEIVKKILEEMMIKKDACITGYGIFEDMNEAIEAATIAQKELLKLSLEQRGNLITAIRKAAKDNAETFAQMAVDETGMGNYGDKVIKNLIAAEKTPGIEDLTTEAFSGDHGLTLVELSPYGVIGSITPTTNPTETVICNSIGMIAAGNAVVFSPHPTAKNTSLKAIEVINKAIIKAGGPPNLITSVANPTIDQANIMMKHKKIKLLVATGGPGVVKAVLSSGKKAIGAGAGNPPAVVDETANLEKAARDIIDGCSFDNNLPCTAEKEVIVVDSVADYLVSYMKKHGAFLITDKEQIQKLTELVVDNGHANKELVGKSVAHILQRIGIEVPSDARVAILNVERNHPLVKAELMMPILPVVRVENVDAAIELAVEAEQGFRHTAIMHSTNIDNLTKFSKEIQTTIFVKNGPSYAGIGIGGEGYATFTIAGPTGEGLTSAKDFARRRKCVLVDGLSIR

SEQ ID NO: 459 - protein, 503 aa, Clostridium sticklandii
MKAGDIVQDFITERDVEKIIEQVLSKLEPVIEQVKPKEINMLPNKTNIDFSQNANGIFESIDLAVESALEAHIILTSYKLEDREKMIQSIRKEVLGDIENIARLVYEETKLGKYEDKIAKINLAASKTPGTEDIKTSAISGDYGLTIEEMAPFGVIGAVTPVTNPVETLINNAISMISGGNSVVFNVHPSSKKSSAYTVELINKAVLKAGGPQNLVTMVKEPTIETVNQLSSHPRISMMVGTGGPGLVKSLLKSGKKTIGAGAGNPPVVVDETADMNLAAKGIIEGASFDNNILCIAEKEVFVVNEVADDLIYNMLSSGAYMLNQEELEKVMKLTLVEDEDLGAKSCTLSPKKKYHVHKNWVGKDASKILSEIGITKQDVKLLICEVDSDHPYVTLEQMMPILPLVRCSDVDEAIKLAVKAEGTNKHTASIFSRNVDNMTKFARAINTTIFVKNAPTLAGVGYKGEGNATFTIAGPTGEGITSAKTFTRVRRCVLAEGGFRIV

SEQ ID NO: 460 - protein, 482 aa, Thermincola potens
MAIEAYQIEKIVEEVMRKMVSGGSGDSFAGKAKGIFESVDEAVKAAKAAQKELVAMRIEKREMLLKAMREAAIAHAEELARLAVEETGMGRVTDKIIKNRVAAEKTPGTENLQPSAVTGDRGLTLIERAPYGVIGAITPSTNPCATVINNSISMVAAGNSVVFSVHPGAKKASLLTVEILNEAIEKAGGPANVLTAVASPSLENTNALMKHPDIKLLVATGGPGLVKAVLSSGKKAIGAGAGNPPALVDETADLERAAKSIVAGASFDNNLPCIAEKEVIVVDYVANQLISYMKQNGAYLANDREIKALMDLVLTKNENLKAEGCTVKPEKLYGGINKEYVGKDAAYIMKKIGVDIPEDTKLIICEVDEDHPFVLEELMMPILPIVRVPNVQKAIEVGVRVEHGNRHTAVMHSQNIDNLSAFARAVQTTIFVKNGPSYAGIGIGGEGYTTFTIAGPTGEGLTAASSFTRQRRCVLVDGFSIV

SEQ ID NO: 461 - protein, 462 aa, Clostridium sp.
MSVNEQMIQDIVSEVMAKMQIASEVSDNHGIFADMNEAIEAAKKAQKIVGRMSMDQREKIISNIRKKTVENAEILARMGVQETGMGNVGHKILKHQLVAEKTPGTEDITTTAWSGDRGLTLIEMGPFGVIGAITPCTNPSETVLCNTIGMLAGGNTVVFNPHPGAIKTSIFAINMINEASLEAGGPDNIACTVEKPTLESSNIMMKHKAIHLIAATGGPGVVTAVLSSGKRGIGAGAGNPPALVDETADIRKAAEDIVNGCTFDNNLPCIAEKEIVAVDSVADELMHYMVSEQGCYLASKEEQEALTAVVLKDGRLNRNCVGRDAKTLLGMIGVSVPDNIRCITFEGPKEHPLIATELMMPILGVVRAKDFDDAVEQSVWLEHGNRHSAHIHSKNVDNITKYAKAIDTAILVKNGPSYAAIGFGGEGFCTFTIASRTGEGLTSASTFTKRRRCVMSDSLCIR

SEQ ID NO: 462 - protein, 470 aa, Fusobacterium sp.
MRGELMEFEVNNIEKIVELIMKKMAESNISTAGNSKNGVFDNVDEAIEEAKKAQAILFSSKLELREKIIASIRDTLKSHVTELAELAVKETGMGRVSDKELKNKIAIEKTPGLEDLKAFAFSGDDGLTVMELSPYGVIGAITPSTNPSETVICNSIGMIAAGNAVIFAPHPGAKRTSIRTVELINEAIRKVGGPDNLVVTIREPSIENTEKIIANPNIKMLVATGGPGVVKTVMSSGKKAIGAGAGNPPVLVDETADIEKAAKDIIAGCSFDNNLPCTAEKEVVAVDSIVNYLIFEMQKNGAYLLKDKKLIEKLLSLVLKNNSPDRKYVGRDAKYLLKQIGIEVGDEIKVIIVETDKNHPFAVEELLMPILPIVKVKDALEGIKVAKELERGLRHTAVIHSKNIDILTKYAREMETTILVKNGPSYAGIGIGGEGHVTFTIAGPTGEGLTSAKSFARNRRCVLVGGFSIK

SEQ ID NO: 463 - protein, 470 aa, Fusobacterium sp.
MRGELMEFEVNNIEEIVELIMKKMAESNISTAGNSKNGVFDNVDEAIEEAKKAQAILFSSKLELREKIIASIRDTLKNHVSELAELAVKETGMGRVADKELKNKIAIEKTPGLEDLKAFAFSGDDGLTVMELSPYGVIGAITPSTNPSETVICNSIGMIAAGNAVIFAPHPGAKRTSIRTVELINEAIRKVGGPDNLVVTIREPSIENTEKIIANPNIKMLVATGGPGVVKTVMSSGKKAIGAGAGNPPVLVDETADIEKAAKDIIAGCSFDNNLPCTAEKEVVAVDSIVNYLIFEMQKNGAYLLKDKELIEKLLSLVLKNNSPDRKYVGRDAKYLLKQIGIEVGDEIKVIIVETDKNHPFAVEELLMPILPIVKVKDALEGIKVAKELERGLRHTAVIHSKNIDILTKYAREMETTILVKNGPSYAGIGIGGEGHVTFTIAGPTGEGLTSAKSFARNRRCVLVGGFSIK

SEQ ID NO: 464 - protein, 462 aa, Ruminococcus sp.
MPISENMVQEIVQEVMAKMQIADAPAGKHGVFKDMNDAIEAAKKAQLVVKTMSMDQREKIITCIRKKIKENAEVLARMGVEETGMGNVGDKILKHHLVADKTPGTEDITTTAWSGDRGLTLIEMGPFGVIGAITPCTNPSETVLCNTMGMLAGGNTVVFNPHPAAVKTSIYAINLLNEASLESGGPDNIAVTVEKPTLETSNIMMKHKDIHLIAATGGPGVVTAVLSSGKRGIGAGAGNPPALVDDTADIRKAAQDIVNGCTFDNNLPCIAEKEVVAVSSVVDELMHYMITENDCYLASKEEQDKLVETVLAGGKLNRKCVGRDAKTLLSMIGVQAPANTRCIIFEGPKEHPLITTELMMPILGIVRAKDFDDAVEQAVWLEHGNRHSAHIHSKNIDNITKYAKAIDTAILVKNGPSYSALGFGGEGFCTFTIASRTGEGLTSASTFTKRRRCVMTDSLCIR

SEQ ID NO: 465 - protein, 465 aa, Fusobacterium nucleatum
MEFEVNNIEEIVELIMKKMAESNISTAGNSKNGVFDNVDEAIEEAKKAQAILFSSKLELREKIIASIRDTLKNHVTELAELAVKETGMGRVADKELKNKIAIEKTPGLEDLKAFAFSGDDGLTVMELSPYGVIGAITPSTNPSETVICNSIGMIAAGNAVIFAPHPGAKRTSIRTVELINEAIRKVGGPDNLVVTIREPSIENTEKIIANPNIKMLVATGGPGVVKTVMSSGKKAIGAGAGNPPVLVDETADIEKAAKDIIAGCSFDNNLPCTAEKEVVAVDSIVNYLIFEMQKNGAYLLKDKELIEKLLSLVLKNNSPDRKYVGRDAKYLLKQIGIEVGDEIKVIIVETDKNHPFAVEELLMPILPIVKVKDALEGIKVAKELERGLRHTAVIHSKNIDILTKYAREMETTILVKNGPSYAGIGIGGEGHVTFTIAGPTGEGLTSAKSFARNRRCVLVGGFSIK

SEQ ID NO: 466 - protein, 465 aa, Fusobacterium nucleatum
MEFEVNNIEEIVELIMKKMTEGGVSTSNNSTNGVFKNVDEAIAEAKKAQTVLFSSKLELRERIIASIRDTLKSHITELSELAVKETGMGRVADKELKNRIAIEKTPGLEDLKAFAFSGDDGLTVMELSPYGVIGAITPSTNPSETVICNSIGMIAAGNAVIFAPHPGAKRTSIRAVELINEAIKKAGGPDNLVVTIAEPSIENTEKIIANPNIKMVVATGGPGVVKTVMSSGKKAIGAGAGNPPVLVDETADIEKAAKDIIAGCSFDNNLPCTAEKEVIAVDSIVNYLIFEMQKNGAYLLKDKELIEKLLSIVLKNNSPDRKYVGKDAKYLLKQIGIEVGDEIKVIIVETDKNHPFAVEELLMPILPIVKVKDALEGIKVAKELEKGLRHTAVIHSKNIDILSKYAREMETTILVKNGPSYAGIGIGGEGHVTFTIAGPTGEGLTSARSFARNRRCVLVGGFSIK

SEQ ID NO: 467 - protein, 470 aa, Fusobacterium sp.
MRGELMEFEVNNIEEIVELIMKKMAESNISTAGNSKNGVFDNVDGAIEEAKKAQAILFSSKLELREKIIASIRDTLKNHVTELAELAVKETGMGRVADKELKNKIAIEKTPGLEDLKAFAFSGDDGLTVMELSPYGVIGAITPSTNPSETVICNSIGMIAAGNAVIFAPHPGAKRTSIRTVELINEAIRKVGGPDNLIVTIREPSIENTEKIIANPNIKMLVATGGPGVVKTVMSSGKKAIGAGAGNPPVLVDETADIEKAAKDIIAGCSFDNNLPCTAEKEVVAVDSIVNYLIFEMQKNGAYLLKDKELIEKLLSLVLKNNSPDRKYVGRDAKYLLKQIGIEVGDEIKVIIVETDKNHPFAVEELLMPILPIVKVKDALEGIKVAKELERGLRHTAVIHSKNIDILTKYAREMETTILVKNGPSYAGIGIGGEGHVTFTIAGPTGEGLTSAKSFARNRRCVLVGGFSIK

SEQ ID NO: 468 - protein, 465 aa, Fusobacterium nucleatum
MEFEVNNLEEIVELIMKKMSESSISTSSNSKNGVFENVDEAIAEAKKAQTILFSSKLELRERIIASIRDTLKPYITELSELAVKETGMGRVSDKEIKNRIAIEKTPGLEDLKAFAFSGDDGLTVMELSPYGVIGAITPSTNPSETVICNSIGMIAAGNAVIFAPHPGAKRTSIRAVELINEAIKKVGGPDNLIVTITEPSIENTEKIIANPNIKMVVATGGPGVVKTVMSSGKKAIGAGAGNPPVLVDETADIEKAAKDIIAGCSFDNNLPCTAEKEVIAVDSIVNYLIFEMQKNGAYLLKDKDLIEKLLSIVLKNNSPDRKYVGKDAKYLLKQIGIEVGDEIRVIIVETSKDHPFAVEELLMPILPIVKVKDALEGIKVAKELEKGLRHTAIIHSKNIDILSKYAREMETTILVKNGPSYAGIGIGGEGHVTFTIAGPTGEGLTSARSFARNRRCVLVGGFSIK

SEQ ID NO: 469 - protein, 465 aa, Fusobacterium nucleatum
MEFEVNNIEEIVELIMKKMSESGVSTSNNSTNGVFENVDEAIAEAKKAQTVLFSSKLELRERIIASIRDTLKTHITELSELAVKETGMGRVADKELKNRIAIEKTPGLEDLKAFAFSGDDGLTVMELSPYGVIGAITPSTNPSETVICNSIGMIAAGNAVIFAPHPGAKRTSIRAVELINEAIKKAGGPDNLVVTIAEPSIENTEKIIANPNIKMVVATGGPGVVKTVMSSGKKAIGAGAGNPPALVDETADIEKAAKDIIAGCSFDNNLPCTAEKEVIAVDSIVNYLIFEMQKNGAYLLKDKELIEKLLSIVLKNNSPDRKYVGKDAKYLLKQIGIEVGDEIKVIIVETDKNHPFAVEELLMPILPIVKVKDALEGIKVAKELEKGLRHTAVIHSKNIDILSKYAREMETTILVKNGPSYAGIGIGGEGHVTFTIAGPTGEGLTSARSFARNRRCVLVGGFSIK

SEQ ID NO: 470 - protein, 470 aa, Fusobacterium sp.
MRGELMEFEVNNIEEIVELIMKKMAESNISTAGNSKNGVFDNVDEAIEEAKKAQAILFSSKLELREKIIASIRDTLKNHVTELAELAVKETGMGRVADKELKNKIAIEKTPGLEDLKAFAFSGDDGLTVMELSPYGVIGAITPSTNPSETVICNSIGMIAAGNAVIFAPHPGAKRTSIRTVELINEAIRKVGGPDNLIVTIREPSIENTEKIIANPNIKMLVATGGPGVVKTVMSSGKKAIGAGAGNPPVLVDETADIEKAAKDIIAGCSFDNNLPCTAEKEVVAVDSIVNYLIFEMQKNGAYLLKDKELIEKLLSLVLKNNSPDRKYVGRDAKYLLKQIGIEVGDEIKVIIVETDKNHPFAVEELLMPILPIVKVKDALEGIKVAKELERGLRHTAVIHSKNIDILTKYAREMETTILVKNGPSYAGIGIGGEGHVTFTIAGPTGEGLTSAKSFARNRRCVLVGGFSIK

SEQ ID NO: 471 - protein, 481 aa, Clostridium asparagiforme
MEIETRDIERIVRQVMAAMEQQGTIAGGAYPPAPGITAPRGDNGVFERVEDAIDAAWAAGRVWAFHYKVEDRRRVIEAIRVMARENARTLAQMVRDETGMGRVEDKVEKHLAVADKTPGVECLTTDAISGDGGLMIEEYAPFGVIGAITPSTNPTETVIHNTISMIAGGNSVVFNVHPGAKKCCAFCLQLLNKTIVENGGPANLITMQRDPTMDAVNKMTSSPKIRLMVGTGGMGMVNALLRSGKKTIGAGAGNPPVIVDDTADVKLAARELYWGASFDNNLFCFAEKEVFVMEASADGLIRGLVEQGAYLLTPAETEAIVKLALIQKDGKYEVNKKWVGKDAGLFLQAIGVSGHENTRLLICDVPKCHPYVMVEQLMPVLPIVRCRTFDECIQCSVEAEQGNRHTSSIFSTNVYNMTKFGKEIETTIYVKNGATLRGLGIGGEGHTTMTIAGPTGEGLTCARSFTRRRRCMLAEGGLRII

SEQ ID NO: 472 - protein, 462 aa, Clostridium phytofermentans
MTVNEQLVQDIIKNVVASMQLTQTNKTELGVFDDMNQAIEAAKEAQLVVKKMSMDQREKIISAIRKKTIEHAETLARMAVEETGMGNVGHKILKHQLVAEKTPGTEDITTTAWSGDRGLTLVEMGPFGVIGAITPCTNPSETIICNTIGMLAGGNTVVFNPHPAAIKTSNFAVQLINEASLSAGGPVNIACSVRKPTLDSSKIMMSHQDIPLIAATGGPGVVTAVLQSGKRGIGAGAGNPPVLVDETADIRKAAEDIINGCTFDNNLPCIAEKEVVAIDAIANELMNYMVKEQGCYAITKEQQEKLTNLVITPKGLNRNCVGKDARTLLGMIGIDVPSNIRCIIFEGEKEHPLISEELMMPILGIVRAKSFDDAVEKAVWLEHGNRHSAHIHSKNVDRITTYAKAIDTAILVKNAPSYAAIGFGGEGFCTFTIASRTGEGLTSASTFTKRRRCVMSDSLCIR

SEQ ID NO: 473 - protein, 470 aa, Fusobacterium sp.
MRGELMELEVKNIEEIVDLIMKKMTESNVAVSYDSKNGVFDDVDVAIAEAKKAQTVLFSSKLELRERIIASIRETMRAHITELSELAVKETGMGRVKDKEQKNRVAIDRTPGLEDLKAFAFSGDDGLTVMEFSPYGVIGAITPSTNPSETVICNSIGMIAAGNAVIFAPHPGAKRTSIRAVELINEAIKKVGGPENLVVTISEPSIENTEKIIANPNIKMLVATGGPGVVKTVMSSGKKAIGAGAGNPPVLVDETADIEKAAKDIIDGCSFDNNLPCTAEKEVIAVDSIVNYLIFEMQKNGAYLLKDKELIEKLVSLVLKNNSPDRKYVGKDAKYILKQLGIEVGDEIRVIIVETDKNHPFAVEELLMPVLPIVKVKDALEGIKVAKELERGLRHTAIIHSKNIDILSKYAREMETTILVKNGPSYAGIGIGGEGHVTFTIAGPTGEGLTSARSFARNRRCVLVGGFSIK

SEQ ID NO: 474 - protein, 462 aa, Lachnospiraceae bacterium
MSVNEKMVQDIVQEVVAKMQISSDVSGKKGVFSDMNEAIEASKKAQKIVAKMSMDQREAIISKIREKIKENAEILARMGVEETGMGNVGHKILKHQLVAEKTPGTEDITTTAWSGDRGLTLIEMGPFGVIGAITPCTNPSETVLCNTIGMLAGGNTVVFNPHPAAIKTSIYAVNLLNEASVEVGGPENIAVTVEHPTMETSDVMMKHKDIHLIAATGGPGVVTAVLSSGKRGIGAGAGNPPALVDETADIRKAAEDIVNGCTFDNNLPCIAEKEIVAVDSIADELLHYMVNEQGCYMISKEEQDALTEVVLKGGRLNRKCVGRDAKTLLGMIGITVPDNIRCITFEGPKEHPLIAEELMMPILGVVRAKDFDDAVEQAVWLEHGNRHSAHIHSKNVDNITKYAKAIDTAILVKNGPSYAALGFGGEGYCTFTIASRTGEGLTSASTFTKRRRCVMTDSLCIR

SEQ ID NO: 475 - protein, 462 aa, Ruminococcus gnavus
MSVNEKMVQDIVQEVVAKMQISSDVSGKKGVFSDMNEAIEASKKAQKIVAKMSMDQREAIISKIREKIKENAEILARMGVEETGMGNVGHKILKHQLVAEKTPGTEDITTTAWSGDRGLTLIEMGPFGVIGAITPCTNPSETVLCNTIGMLAGGNTVVFNPHPAAIKTSIYAVNLLNEASVEVGGPENIAVTVEHPTMETSDIMMKHKDIHLIAATGGPGVVTAVLSSGKRGIGAGAGNPPALVDETADIRKAAEDIVNGCTFDNNLPCIAEKEIVAVDSIADELLHYMVSEQGCYMISKEEQDALTEVVLKGGRLNRKCVGRDAKTLLGMIGITVPDNIRCITFEGPKEHPLIAEELMMPILGVVRAKDFDDAVEQAVWLEHGNRHSAHIHSKNVDNITKYAKAIDTAILVKNGPSYAALGFGGEGYCTFTIASRTGEGLTSASTFTKRRRCVMTDSLCIR

SEQ ID NO: 476 - protein, 462 aa, Ruminococcus obeum
MPISESMVQDIVQEVMAKMQIADAPTGKHGVFKEMNDAIEAAKKAELIVKKMSMDQREKIITCIRKKIKENAEVMARMGVDETGMGNVGDKILKHHLVADKTPGTEDITTTAWSGDRGLTLIEMGPFGVIGAITPCTNPSETVLCNTIGMLAGGNTVVFNPHPAAIKTSIFAINLVNEASLEAGGPDNIAVTVEKPTLETSNIMMKHKDIPLIAATGGPGVVTAVLSSGKRGIGAGAGNPPAVVDETADIRKAAQDIVNGCTFDNNLPCIAEKEVVAVSSVVDELMHYMLTENDCYLASKEEQDKLTEVVLAGGKLNRKCVGRDAKTLLSMIGVNAPANTRCIIFEGPKEHPLITTELMMPILGVVRARDFDDAVEQAVWLEHGNRHSAHIHSKNIDNITKYAKAIDTAILVKNGPSYSALGFGGEGYCTFTIASRTGEGLTSASTFTKRRRCVMSDSLCIR

SEQ ID NO: 477 - protein, 473 aa, Clostridium saccharolyticum
MEIGAKEIELIVREVLAGIESRGPKLSYIPAQSDNGVFERVEDAIGAAHTAQREWVEHYRVEDRRRIIEAIRMTAKSHAKTLAKLVWEETGMGRFEDKIQKHMAVIEKTPGVECLTTDAISGDEGLMIEEYAPFGVIGAITPSTNPTETIINNTISMIAGGNAVVFNVHPGAKKCCAHCLKLLHQAIVENGGPANLITMQKEPTMEAVTKMTSDPRIRLMVGTGGMPMVNALLRSGKKTIGAGAGNPPVIVDDSADVSLAAREIYRGASFDNNILCLAEKEVFVMEKAADELVNNLVKEGAYLLNPMELNEILKFAMIEKNGSCEVNKKWVGKDAGLFLEAIGVSGHKDVRLLICETDRNHPFVMVEQLMPILPIVRLRTFEECVESAVAAESGNRHTASMFSRNVENMTRFGKVIETTIFTKNGSTLKGVGIGGEGHTTMTIAGPTGEGLTCARSFTRRRRCMLAEGGLRII

SEQ ID NO: 478 - protein, 471 aa, Flavonifractor plautii
MNIDENVVESIVKRVVSQLSTETASAQTCPSGGDWGVFESMNDAVDAAVEAQREYLNRSMHDRACYVQAIRDVVLDQENLEYISRLAVEETGMGGYEYKLIKNRLAAVKTPGIEDLTTDAMSGDDGLTLVEYSPFGVIGSITPTTNPTETIICNSIGMLAAGNAVVFSPHPRAKKVSLHLIQLINKALCKAGAPANLVVTVSAPSIENTNAMMSHPKIRMLVATGGPAIVKTVLSSGKKAIGAGAGNPPVVVDETADIEKAAKDIVDGCSFDNNLPCIAEKEVIAVDSVADYLIFNMKKNGAYEVKDPAVISQLVELVTKEGKSPKTEFVGKSAKYILDKIGITVGDDVKVILMEAKEDHPFVQVELMMPILPLVRVPDVDQAIEMAVRVEHGNRHTAMMHSRNVEKLTKMAKLIQTTIFVKNGPSYAGIGVGGEGYTTFTIAGPTGEGLTSAKSFARRRRCVLVGGMDVR

SEQ ID NO: 479 - protein, 462 aa, Ruminococcus obeum
MPISESMVQDIVQEVMAKMQIADAPTGKHGIFKDMNDAIEAAKKSELIVKKMSMDQREKIITCIRKKIKENAEVMARMGVDETGMGNVGDKILKHHLVADKTPGTEDITTTAWSGDRGLTLIEMGPFGVIGAITPCTNPSETILCNTMGMLAGGNTVVFNPHPAAIKTSIFAINLVNEASLEAGGPDNIAVTVEKPTLETSNIMMKHKDIPLIAATGGPGVVTAVLSSGKRGIGAGAGNPPAVVDETADIRKAAQDIVNGCTFDNNLPCIAEKEVVAVSSVVDELMHYMLTENDCYLASKEEQDKLTEVVLAGGKLNRKCVGRDARTLLSMIGVNAPANIRCIIFEGPKEHPLITTELMMPILGIVRAKDFDDAVEQAVWLEHGNRHSAHIHSKNVDNITKYAKAIDTAILVKNGPSYSALGFGGEGYCTFTIASRTGEGLTSASTFTKRRRCVMSDSLCIR

SEQ ID NO: 480 - protein, 469 aa, Clostridium carboxidivorans
MELQSNELSLIIEKVLKEMNKKELKEEVSDGVFDTMEEAIEAAYEAQKKFSSYTIEQREKLIAAMRKAIIDNAMEIANLCVNESGMGRVDHKYLKLKLTAEKTPGTEVLQTTAFTGDKGLTLVENGAFGVIGSITPSTNPAATVACNGIGMLAGGNTAVFSPHPGAFRSSLAMLRALNKAIKEAGGPDNLLTSVKKPSIESTNSMMKNDKIRMVVATGGPGIVKMVLSSGRKAIGAGAGNPPVVVDETADIKKAARDIIAGCTFDNNLPCIAEKEALVVEAVYEELIKEMKNNRAVYELNDEEAAKVAELVLVHNKEKNTYSINKAFVGKDAKYILQNIGKNDAEGVECLIYRAENSHPFVQEELMMPILPIVKTKDFEEALKLAVQDEHGNRHTAIMHSKNVDNLTKMARAIDTTIFVKNAPSYAGIGFGGEGYTTFTIAGPTGEGLTNAVSFTRKRRCTMAESFRIV

SEQ ID NO: 481 - protein, 469 aa, Fusobacterium ulcerans
MNLEANNMDEIVALIMKELKKTDIKAGCQSCESPKNGVFSSMDEAIAAAKKAQEILFSSRLEMREKIVASIREVMKDYVVELAELGVKETGMGRAADKALKHQVTIEKTPGVEDLRAFAFSGDDGLTVMELSPYGVIGAITPSTNPSETIICNSIGMISAGNSVVFAPHPGAKRTSIKTVEIINEAVRKAGGPENLVVTIAEPSIENTNRMMENPDIKMLVATGGPGVVKSVMSSGKKAIGAGAGNPPVLVDETADIEKAARDIVAGCSFDNNLPCIAEKEVVAVDSITDYLIFEMQKNGAYLIKDKSVIDRLVAMVLKNGSPNRAYVGKDASYILKDLGINVGGEIRVIITEADKDHPFAVEELLMPILPIIRVKNALEGIEVSKKLEHGLRHTAMIHSKNIDILTKYARDMETTILVKNGPSFAGIGVGGEGHTTFTIAGPTGEGLTSAKSFARNRRCVLVGGLSIK

SEQ ID NO: 482 - protein, 469 aa, Fusobacterium sp.
MNLEANNMDEIVALIMKELKKTDIKAGCQSCESLKNGVFSSMDEAIAAAKKAQEILFSSRLEMREKIVASIREVMKDYVVELAELGVKETGMGRAADKALKHQVTIEKTPGVEDLRAFAFSGDDGLTVMELSPYGVIGAITPSTNPSETIICNSIGMISAGNSVVFAPHPGAKRTSIKTVEIINEAVRRAGGPENLVVTIAEPSIENTNRMMENPDIKMLVATGGPGVVKSVMSSGKKAIGAGAGNPPVLVDETADIEKAARDIVAGCSFDNNLPCIAEKEVVAVDSITDYLIFEMQKNGAYLIKDKSVIDRLVAMVLKNGSPNRAYVGKDASYILKDLGINVGDEIRVIITETDKDHPFAVEELLMPILPIIRVKNALEGIEVSKKLEHGLRHTAMIHSKNIDILTKYARDMETTILVKNGPSFAGIGVGGEGHTTFTIAGPTGEGLTSAKSFARNRRCVLVGGLSIK

SEQ ID NO: 483 - protein, 457 aa, Roseburia inulinivorans
MVHDIVQKVMANMQISGSVSGMHGVFKDMNDAINASIEAQKKVCTMTLDQREQIISLIRKKTHENAEILANMGVNETGMGNVGDKILKHHLTADKVPGTEDISTIAWSGDRGLTLVEMGPFGVIGAITPATNPSETVICNCIGMLAGGNTVVFNPHPNAKKTTIYTINMINEASIEAGGPDNIAVTVEAPTLDTSAIMMKHPSIHLLVATGGPGVVTAVLSSGKRAIGAGAGNPPVLVDETADIRKAAQDIVNGCTFDNNLPCIAEKEIVAVDSVADELMNYMISENGCYLASKEIQDKLVQTVFTPKGALNRKCVGRSAQTLLAMVGVNVGPEIRCIVFEGQKEHPLIAEELMMPILGMVRVKSFEEGVETAVWLEHGNRHSAHIHSKNVDHITTYARALDTAILVKNGPSYAALGFGGEGYCTFTIASRTGEGLTAAHSFTKSRRCTMSDSLCIR

SEQ ID NO: 484 - protein, 469 aa, Clostridium carboxidivorans
MELESNELSVIIEKVLKEMNKKEFGKKESDGIFDTMDEAVEASYEAQKKYSSYSLEQREKLIQAMRKAIMDNAMEVANLCVKESGMGRVDHKYLKLKLIVEKTQGTEILRPEVYTGDNGLTLIEHGAFGVIGAITPSTNPAATVACNSICMLAGGNTVVFSPHPGALNSCLTMIRILNKAIKEAGGPENLITSVKAPSIENTNIMINHKRIRLVVATGGPGIVKLVLSSGKKAIGAGAGNPPVVVDETADIPKAARDIIAGCSFDNNLPCIAEKEAIVVESVYEELIKEFKKNRVVYELTDEEAEKLVGKVLNYDEKNKKYSINKKFVGKDAKYLLESIGKDAGTGVECLIYRAENSHPFVQEELMMPILPIVKVKNVDEAIETAVEDEHGNRHTAMMHSKNVVNLTKMARAIDTTIFVKNAPSYAGIGFGGEGHTTFTIAGPTGEGITNAVTFTRQRRCTMVDSFRIV

SEQ ID NO: 485 - protein, 471 aa, Clostridium sp.
  Clostridium cf. saccharolyticum K10
MEMDMKVIEQLVAQALKEMKAEEPAAFAEKKEENYGVFSTMDEAIEASEKAQKALLFSKIQDRQKYVDIIRAAILKRENLELISRMAVEETEIGKYEHKLIKNRLAAEKTPGTEDLTTEAQTGDHGLTLVEYCPFGVIGAITPTTNPTETIICNSISMIAGGNTVVFSPHPRAKKVSQLLVKMLNKALMEGGAPANLITMVEEPSIENTNKMIEHPGVRLLVATGGPAIVKKVLSSGKKAIGAGAGNPPVVVDETADIEKAARDIVDGCSFDNNVPCIAEKEVFAVDSICDYLIQNMKLNGAYEIRDAETIERLDALVTNEKGGPKTSFVGKSAKYILDKMGIPADDSVKVIIMEVRRDHHLVTEEMMMPILPIVRVSDVDTAIEYAHDAEHGNRHTAMMHSKNVEKLSKMAKLLETTIFVKNAPSYAGIGAGGEGHATFTIAGPTGEGLTSARSFCRKRRCVMSDAFSIR

SEQ ID NO: 486 - protein, 469 aa, Fusobacterium varium
MNLEANNMDEIVALIMKELKKTDIKTVCQSCENPKNGVFSSMDEAITAAKKAQEILFSSRLEMREKIVASIREVMKDYVLELAELGVKETGMGRVADKALKHQVTIEKTPGVEDLKAFAFSGDDGLTVMELSPYGVIGAITPSTNPSETIICNSIGMISAGNSIVFAPHPGAKRTSIKTVEIINEAVRKVGGPENLVVTIAEPSIENTNKMMANPDIKMLVATGGPGVVKSVMSSGKKAIGAGAGNPPVLVDETADIEKAAKDIVAGCSFDNNLPCIAEKEVVAVDSITDYLIFEMQKNGAYLIKDKAVIERLAGMVLKNGSPNRAYVGKDASYILKDLGINVGDEIRVIIAETDKEHPFAVEELLMPILPIIRVKNALEGIEVSKKLEHGLRHTAMIHSKNIDVLTKYARDMETTILVKNGPSFAGIGVGGEGHTTFTIAGPTGEGLTSAKSFARNRRCVLVGGLSIK

SEQ ID NO: 487 - protein, 482 aa, Clostridium celatum
MDDNTKLIQDIVAKVISEIGTKEIEEEACCGNGSCGGSCGCNKEKYVFEDVDSAVAAAKKAYKELKQLTIKDRENIITKIREKCLTYSERLSIMAVDETGMGKVEDKITKHVLVARKTPGTEDLTTTAWSGDGGLTLVERGAFGVIAAITPSTNPTATIFCNSIGMIAAGNSVVFAPHPAAKSCSKFAVKLINEASIEVGGPENIVVTFENPSIEITSALMKHKDIPFISATGGPGVVTQACSSGKRAIGAGAGNPPVLVDETADIKHAAKSIIAGATFDNNLPCIAEKEVVALDSICDELIEDMQKEGAYFLNSTELINRLIDTVLIRKDGKVTLNRNFVGRDAKIILDAIGVYADDSVKCIIFEGCKSNLLIVEELMMPILGIVRVKDFNTAVDVAVELEHGNRHSAHIHSKRIDRLTYFAREIDTAIFVKNAPSYSALGVEAEGYPTFTIASRTGEGLSSAKTFSKSRRCIMKDALSIK

SEQ ID NO: 488 - protein, 462 aa, Clostridium sp.
MSVNERMVQDIVQEVVAKMQIASDVTGNHGVFQDMNAAIEAAKKTQKVVARMSMDQREKIISNIRAKIKEHAEIFARMGVQETGMGNVGHKILKHQLVAEKTPGTEDIQTTAWSGDRGLTLIEMGPFGVIGAITPCTNPSETVLCNTIGMLAGGNTVVFNPHPAAIKTSIYAVNLINEASLEAGGPDNIACTVENPTLESSNIMMKHKDIPLIAATGGPGVVTAVLSSGKRGIGAGAGNPPALVDETADIRKAAEDIVNGCTFDNNLPCIAEKEIVAVDSIADELMHYMISEQGCYLASKEEQDALTEVVLKGGRLNRKCVGRDAKTLLGMIGVTVPDNIRCITFEGPKEHPLIAEELMMPILGVVRAKDFDDAVEQAVWLEHGNRHSAHIHSKNVDNITKYAKAIDTAILVKNGPSYAAIGFGGEGFCTFTIASRTGEGLTSASAFTKRRRCVMCDSLCIR

SEQ ID NO: 489 - protein, 462 aa, Lachnospiraceae bacterium
MSVNEQMVQDIVQEVMAKMQITSDVSGSHGVFKDMNEAIAAAKKTQKIVGKMSMDQREKIISNIRTKIKENAEIMARMGVQETGMGNVGHKILKHVLVAEKTPGTEDITTTAWSGDRGLTLIEMGPFGVIGAITPCTNPSETVLCNTIGMLAGGNTVVFNPHPAAIKTSIFAINLLNEASLEAGGPDNIACTVEKPTLASSDIMMKHKDIPLIAATGGPGVVTAVLSSGKRGIGAGAGNPPALVDETADIRKAAEDIVNGCTFDNNLPCIAEKEIVAVDSIADELMYYMVSEQGCYKITKEEQDALTAVVLKDGKLNRKCVGRDAKTLLGMIGVTVPDNIRCITFEGPKEHPLIAEELMMPILGVVRAKDFDDAVEQAVWLEHGNRHSAHIHSKNVDNITTYAKAIDTAILVKNGPSYAALGFGGEGYCTFTIASRTGEGLTSASTFTKRRRCVMTDSLCIR

SEQ ID NO: 490 - protein, 463 aa, Lachnospiraceae bacterium
MPVSESMVQDIVKEVVARMQLSGSAGTAQHGVFTDMNQAIEAAKEAEAKVRCMTMDQREQIVSNIRRKTHENAELLARMGVEETGMGNVGDKILKHHLLADKTPGTEDITTTAWSGDRGLTLIEMGPFGVIGAITPCTNPSETVLCNSMGMIAAGNTVVFNPHPQAIKTSIFAINMVNEASLEAGGPDNVACTVSKPTLETSNIMMKHKDIPLIAATGGPGVVTAVLSSGKRGIGAGAGNPPALVDETADVRKAAADIVNGCTFDNNLPCIAEKEIVAVDSVADELMNYMISEQGCYLISKEEQDKLTATVITPKGLNRKCVGRDARTLLSMIGIQAPENIRCIVFEGEKEHPLIAEELMMPILGLVRAKDFDDAVEKAVWLEHGNRHSAHIHSKNVDNITKYAKAIDTAILVKNAPSYAALGFGGEGFCTFTIASRTGEGLTSASTFTKRRRCVMSDSLCIR

SEQ ID NO: 491 - protein, 462 aa, Ruminococcus sp.
MPINENMVQEIVQEVMAKMQIADAPTGKHGIFKEMNDAIEAAKKSQLIVKKMSMDQREKIITCIRKKIKENAEVMARMGVEETGMGNVGDKILKHHLVADKTPGTEVITTTAWSGDRGLTLIEMGPFGVIGAITPCTNPSETILCNTMGMLAGGNTVVFNPHPAAIKTSIYAINLLNEASLESGGPDNIAVTVEKPTLETSNVMMKHKDIPLIAATGGPGVVTAVLSSGKRGIGAGAGNPPALVDETADIRKAATDIVNGCTFDNNLPCIAEKEIVAVSSIVDELMHYLVTENDCYLASKEEQDKLTEVVLAGGKLNRKCVGRDARTLLSMIGVNAPANIRCIVFEGPKEHPLITTELMMPILGVVRARDFDDAVEQAVWLEHGNRHSAHIHSKNIDNITKYAKAIDTAILVKNAPSYAALGFGGEGYCTFTIASRTGEGLTCASTFTKRRRCVMADSLCIR

SEQ ID NO: 492 - protein, 469 aa, Acetobacterium woodii
MNIDTTGIEYIVKKVMAEIDCAEEGGKPLKDGELGIFNDMENAIDAAFIAQKSFMRASMAFRSKIIAAMRAEMLKKENMEMICQMAVEETGMGNYEHKLLKHELAATKTPGVEDLVADAFTGDDGLTLIEQSPFGVIGAVSPSTNPSETIICNGIGMLAGGNTVVFAPHPSAKKTSALVVKLLNKAILEAGGPENLIVTTVKPTIDSANTMFASPKITMLCATGGPGVVKSVLQSGKKAIGAGAGNPPALVDETADIEKAGKDIIDGCCFDNNLPCIAEKEVVVVEQVADYLIFNMKKNGAYELKDAQKIKELEELVIPGGRLSRDYVGRSAKVILKGIGIEVDDSVRVVIIETSKDHIFAVEELMMPILAIVRVKDVAEGIDLAVSLEHGNRHTAIMHSTNINNLTEMAKRVQTTIFVKNGPSYAGIGVGGEGYTTFTIAGPTGEGLTSAKTFTRKRRCVLVGGFTIK

SEQ ID NO: 493 - protein, 497 aa, Clostridium botulinum
MNDFNMIDIESIVKNIVKELTGNEKGQGAITTATAPKEANPLVDIEKKIMGFMNTPTMPVGEYGVFEDINDAIEQAWLAEQEYRKVGLDKRTEIIEAFKAEVRKNVEEISRRTFEETGMGRYEDKILKNNLALDKTPGVEDLEAGVKTGDGGLTLYEMSPFGVIGAIAPSTNPTETIINNGISMLAGGNTVVFSPHPGAKDVSVFIVQLINKAIERINGPKNLIVTVKNPNIESTNIMLAHPKVNMICATGGPGIVKVALSSGKKAIGAGAGNPPVVVDETADIEKAAVDIIDGCSFDNNLPCICEKEVIVVDKVADYLKTCMSKYCALEITDKNMLAQLEKLVLTENGTINKQFVGKNADYIMSKLGVNIDPSIRVIFAEVEANHPFAVEELMMPILPVIRVRNVDEAIDLGVELEHGNRHTAIMHSKHIDNLSKFAKAVQTTIFVKNAPSYAGIGYGAEGHGTFTIAGPTGEGLTSARTFTRKRRCVMVDNFSIK

SEQ ID NO: 494 - protein, 497 aa, Clostridium botulinum
MNDFNMIDIESIVKNIVKELTGNEKEQGAIITATAPKEVNPLVDIEKKIMGFMNTPTMQAGEYGVFEDINDAIEQAWLAEQEYRKVGLDKRTEIIEVFKAEVRKNVEEISRRTFEETGMGRYEDKILKNNLALDKTPGVEDLEAGVKTGDGGLTLYEMSPFGVIGAIAPSTNPTETIINNGISMLAGGNTVVFSPHPGAKDVSVFIIQLINKAIERVNGPKNLIVTVRNPNIESTNIMLSHPKVNMICATGGPGIVKVALSSGKKAVGAGAGNPPVVVDETADIEKAAVDIIDGCSFDNNLPCICEKEVIVVDKVTDYLKTCMSKYCALEITDKNMLAQLEKLVLTENGTINKKFVGKNADYIMSKLGINIDPSIRVIFAEVGANHPFAVEELMMPILPIIRVRNVDEAIELGVELEHGNRHTAIMHSKHIDNLSKFAKAVQTTIFVKNAPSYAGIGYGAEGHGTFTIAGPTGEGLTSARTFTRKRRCVMVDNFSIK

SEQ ID NO: 495 - protein, 497 aa, Clostridium botulinum
MNDFNMIDIESIVKNIVKELTGNEKEQGTITTAAVPKEVNPLVDIEKKIMGFVNTPTMPIGEHGVFEDINDAIEQAWIAEQEYRKVGLDKRTEIIEAFKAEVRKNVEEISRRTFEETGMGRYEDKILKNNLALDKTPGVEDLEAGVKTGDGGLTLYEMSPFGVIGAIAPSTNPTETIINNGISMLAGGNTVVFSPHPGAKDVSVFIIQLINKAIERVNGPKNLIVTVRNPNIESTNIMLAHPKVNMICATGGPGIVKVALSSGKKAIGAGAGNPPVVVDETADIEKAAVDIIDGCSFDNNLPCICEKEVIVVDKVADYLKTCMSKYCALEITDKNMLAQLEKLVLTENGTINKKFVGKNADYIMSKLGVNIDPSIRVIFAEVEANHPFAVEELMMPILPVIRVRNVDEAIDLGVELEHGNRHTAIMHSKHIDNLSKFAKAVQTTIFVKNAPSYAGIGYGAEGHGTFTIAGPTGEGLTSARTFTRKRRCVMVDNFSIK

SEQ ID NO: 496 - protein, 462 aa, Eubacterium plexicaudatum
MSVNDQMVQDIVRQVLANMRISSDASGSRGVFSDMNEAVEAAKKAQAVIGKMPMDHREKIISSIRAKIMENAEILARMGVKETGMGNVGHKILKHQLVAEKTPGTEDITTKAWSGDRGLTLIEMGPFGVIGAITPCTNPSETILCNTIGMVAGGNTVVFNPHPAAIKTSIFAVNLVNEASVEAGGPDNIACTVEHPTLDTSAIMMKHKDIHLIAATGGPGVVTAVLSSGKRGIGAGAGNPPALVDETADIRKAAEDIVNGCTFDNNLPCIAEKEIVAVDSIADELMHYMISEQGCYLASAKEQEALISVVLKGGQLNRDCVGRDAKTLLGMIGVQAPDNIRCITFEGPKEHPLITEELMMPILGVVRADSFEDAVEKAVWLEHGNRHSAHIHSKNVDHITTYAKAIDTAILVKNGPSYAAIGFGGEGYCTFTIASRTGEGLTSASAFTKRRRCVMCDSLCIR

SEQ ID NO: 497 - protein, 467 aa, Thermosediminibacter oceani
MVDEKVVEAIAKRIIEELNLCESGSSGGESREELGIFDNLDDAVEAASQAQKRFAALDLEKREEIIQAIREACLNNARYLAELTVNETGIGRVEDKIVKNILAAKKTPGTEDLRPSCWTGDHGLTLVEMAPVGVIGSITPVTNPVATVINNSISMLAAGNAVVFNPHPSAKRSSNKAVEIINEAIMKVGGPRHLVNSVAEPTIETAKALMAHPKVNLVSVTGGKAVVSEALRSGKKVIGAGAGNPPVVVDETADIVKAAHDIYCGASFDNNLPCIAEKELIAVEAVADMLLERLAREGAYILRGKDVEKITEVVFDENHRINKKLVGKDASFILEQIGIQVGKDVRLVVVPVNPEHPLVHHEQLMPVLPFVRVPNIQEAVELAVRAEGGNRHTAVMHSKNVDNMTNFARAIQTTIFVKNAPSYAGIGFGGEGYATFTIAGPTGEGLTSARTFTRQRRCVLVDAFRII

SEQ ID NO: 498 - protein, 479 aa, Clostridium clostridioforme
MEISEKEVEAIVRSVLSGLGQKSFQAEALHVKDKMCSDGEDGIFELVEDAIEAASKAQKEWVHRYKLKDRKRIIEAIRVTSRAHAESLARMVHEETGMGRYEDKITKHMAVIDKTPGVECLVTDAISGDEGLMIEEPAPFGVIGAITPSTNPTETMINNTISMIAGGNAVVFNVHPGAKKCCAYCLQILHRAIVENGGPKNLITMQREPDMDAVHKLTSSPHIRLMVGTGGMGMVHALLCSGKRTIGAGAGNPPVVVDDTADLSLAARELYRGASFDNNLLCLAEKEVFVMDNVAEELVDRLVGEGAYLLDDLQLKKITELAMVNKDGKYEVNKKWVGKDAGKFLEAIGIQEHREPRLLICVTDRSHPFVKVEQLMPVLPIVRCGSFEKCVEWAVDTEAGNRHTASIFSKNVEHMTLFGKEIETTIYTKNGATLKGIGIGGEGHTTMTIAGPTGEGLTCARSFTRRRRCMLAEGGLRII

SEQ ID NO: 499 - protein, 471 aa, Clostridium clostridioforme
MDMDIKVIEQMVEQALKEIKAEQPQKFTMPKAELYGVFKTMDEAIAASEEAQKKLLFSKISDRQKYVDVIRRTILKRENLEMISRLSVEETEIGDYEHKLIKNRLAAEKTPGTEDLLTEAMTGDNGLTLVEYCPFGVIGAITPTTNPTETIINNSISMIAGGNTVVFSPHPRAKKVSQMTVKLLNKALTESGAPENLITMVEEPSIENTNKMIENPSVRLLVATGGPSIVKKVLSSGKKAIGAGAGNPPVVVDETADIVKAAKDIVDGCSFDNNVPCIAEKEVFAVDSICDYLIHNMKENGAYQITDPALLEKLVTLVTNEKGGPKTSFVGKSARYILDKLGITADASVRVIIMEVPKEHLLVQEEMMMPILPVVRVCDVDTAIEYARQAEHGNRHTAMMHSRNVEKLSKMAKIMETTIFVKNAPSYAGIGVGGEGYTTFTIAGPTGEGLTSPRAFCRKRKCVMTDAFSIR

SEQ ID NO: 500 - protein, 472 aa, Ilyobacter polytropus
MNLDANNLNNIVSLIMKELDKNNNIDDTGQGCGGEEGKNGIFSSMDTAVSKAKEAQVTLFASKLELRERIIKAIREDVREAAAELAEIAVEETGMGRVDDKTLKHYVTVDKTPGVEDLRAFAYSGDNGLTVMELSPYGVIGSITPSTNPSETIVCNAIGMIAAGNSVVFAPHPGAKKTSLRAVEILNKAVARAGGPNNLVVTIFEPSIENTNKMVKNPDIKMVVATGGPGVVKSVMSSGKKAIGAGAGNPPVLVDETADIEKAAKDIVNGCSFDNNLPCITEKEVVAVDSITDYLIFEMQKNGAYLVQDSKTIKKLCEMVINDGSPNRAYVGKNASYILKDLGIDVGDEIKVIIVETDAGHPLAVLEMLMPVLPIVRVKDALEGIKVCKKLEDGLRHTAMIHSKNIDILTKYARDMETTILVKNGPSYSGIGVGGEGYTTFTIAGPTGEGLTSAKSFARNRRCALVGGLSIK

SEQ ID NO: 501 - protein, 462 aa, Shuttleworthia satelles
MADEQLVQNVVREVVARMQISAPARGMHGVFSDMEEAIEAARTAQQTVRLLPMDQREKIIGAIRRKTRENAEILARMAVNETGMGNVGDKILKHLLVADKVPGTEDISTRAFSGDRGLTLIEMGPFGVIGAITPCTNPSETVLCNTIGMLAGGNTVVFNPHPQAIKTTLFTIQMVNEASLEAGGPDNIACTVDAPTLATSEIMMKSPHIKLLVATGGPGVVTAVLSSGKRAIGAGAGNPPALVDETADIRKAAEDIVNGCTFDNNLPCIAEKEIVAVDSIADELLHYMLTEQGCYQASEEELDRLTKAVMDEKGRLNRKAVGRSARKLLSMIGVEVDANIRCITFFGPKEHPLITTELMMPILGIVRVKDFAEGLETAAWLEHGNKHSAHIHSKNVDRITEYARRLDTTITVKNGPSYAALGFGGESYCTFTIASRTGEGLTSARSFIKSRHCVMTDSLCVR

SEQ ID NO: 502 - protein, 472 aa, Clostridium beijerinckii
MDVDVVLVEKLVRQAIEEVKNKNLLNLDKFESVKNYGIFGTMDAAVEASFVAQKQLLNASMTDKQKYVDTIKATILKKENLELISRMSVEETEIGKYEHKLIKNRVAAEKTPGIEDLTTEAMTGDNGLTLVEYCPFGVIGAITPTTNPTETIICNSISMIAGGNTVVFSPHPRAKNVSIKLVTMLNKALEEAGAPDNLIATVKEPSIENTNIMMEHPKIRMLVATGGPAIVNKVMSTGKKAIGAGAGNPPVVVDETADIEKAAIDIVNGCSFDNNVPCIAEKEVFAVDQICDYLIHYMKLNGAYEIKDRDLIQKLLDLVTNENGGPKVSFVGKSAPYILNKLGISVDENIKVIIMEVEKNHHFVLEEMMMPILPIVRTKDVDEAIECAYVAEHGNRHTAIMHSKNVDKLTKMARLLETTIFVKNAPSYAGIGVGGEGTTTFTIAGPTGEGLTTARSFCRKRRCVMVDAFNIR

SEQ ID NO: 503 - protein, 471 aa, Clostridium clostridioforme
MDMDIKVIEQMVEQALKEIKAEQPQKFTMPKAELYGVFKTMDEAIAASEEAQKKLLFSKISDRQKYVDVIRRTILKRENLEMISRLSVEETEIGDYEHKLIKNRLAAEKTPGTEDLLTEAMTGDNGLTLVEYCPFGVIGAITPTTNPTETIINNSISMIAGGNTVVFSPHPRAKKVSQMTVKLLNKALTESGAPENLITMVEEPSIENTNKMIENPSVRLLVATGGPSIVKKVLSSGKKAIGAGAGNPPVVVDETADIVKAAKDIVDGCSFDNNVPCIAEKEVFAVDSICDYLIHNMKENGAYQITDPALLEKLVTLVTNEKGGPKTSFVGKSARYILDKLGITADASVRVIIMEVPKEHLLVQEEMMMPILPVVRVCDVDTAIEYARQAEHGNRHTAMMHSRNVEKLSKMAKIMETTIFVKNAPSYAGIGVGGEGYTTFTIAGPTGEGLTSPKAFCRKRKCVMTDAFSIR

SEQ ID NO: 504 - protein, 473 aa, Clostridium sp.
MKLDDKLIEQVARLVMEEMKSGSAAACEENGTCGDSYGIFDSMDDAVQASEAAQRKYLFSTMEDRQKYVDVIRQTVLEPEMLQKISRMAVEETGMGNYEHKLIKNRLAAEKSPGTEDLVTEAMTGDRGLTLVEYCPFGVIGAVTPATNPTETIICNSIAMLAGGNTVVFSPHPRAKNVTHVLVTALNQALEKVGAPTNLIVTVREPSVENTNLMIKHPKIRVLVATGGPGIVKMVMSTGKKAIGAGAGNPPVVVDETADIEKAAKDIVDGCSFDNNLPCIAEKEVIAVDTIADCLIWHMKRVGAFELKEESAISRLLQLVTNEKGGPKVEFVGKSAPYILNKLGISGGENARVILMETQKDHPFVMEELMMPILPIVRAADVDEAIEIALVAERGNRHTAMMHSKNVDKLTKMAKLLQTTIFVKNAPSYAGIGVGGEGCTTFTIAGPTGEGLTTARSFCRKRRCVMSDALHIR

SEQ ID NO: 505 - protein, 478 aa, Clostridium bolteae
MKEGVIRLDMDIKVIEQLVEQALKEIKAEQPLKFTAPKLERYGVFKTMDEAIAASEEAQKKLLFSKISDRQKYVDVIRSTIIKRENLELISRLSVEETEIGDYEHKLIKNRLAAEKTPGTEDLLTEAITGDNGLTLVEYCPFGVIGAITPTTNPTETIINNSISMIAGGNTVVFSPHPRAKKVSQMTVKMLNKALIDNGAPPNLITMVEEPSIENTNKMIDNPSVRLLVATGGPSIVKKVLSSGKKAIGAGAGNPPVVVDETADIDKAAKDIVDGCSFDNNVPCIAEKEVFAVDSICDYLIHHMKENGAYQITDPMLLEQLVALVTTEKGGPKTSFVGKSARYILDKLGITVDASVRVIIMEVPKDHLLVQEEMMMPILPVVRVSDVDTAIEYAHQAEHGNRHTAMMHSKNVEKLSKMAKIMETTIFVKNAPSYAGIGVGGEGYTTFTIAGPTGEGLTSPRTFCRKRKCVMTDAFSIR

SEQ ID NO: 506 - protein, 471 aa, Clostridium bolteae
MDMDIKVIEQLVEQALKEIKAEQPLKFTAPKLERYGVFKTMDEAIAASEEAQKKLLFSKISDRQKYVDVIRSTIIKRENLELISRLSVEETEIGDYEHKLIKNRLAAEKTPGTEDLLTEAITGDNGLTLVEYCPFGVIGAITPTTNPTETIINNSISMIAGGNTVVFSPHPRAKKVSQMTVKMLNKALIDNGAPPNLITMVEEPSIENTNKMIDNPSVRLLVATGGPSIVKKVLSSGKKAIGAGAGNPPVVVDETADIDKAAKDIVDGCSFDNNVPCIAEKEVFAVDSICDYLIHHMKENGAYQITDPMLLEQLVALVTTEKGGPKTSFVGKSARYILDKLGITVDASVRVIIMEVPKDHLLVQEEMMMPILPVVRVSDVDTAIEYAHQAEHGNRHTAMMHSKNVEKLSKMAKIMETTIFVKNAPSYAGIGVGGEGYTTFTIAGPTGEGLTSPRTFCRKRKCVMTDAFSIR

SEQ ID NO: 507 - protein, 468 aa, Eubacterium hallii
MNIDVELIEKVVKKVLNDVETGSSESEYGYGIFDTMDEAIEASAKAQKEYMNHSMADRQRYVEGIREVVCTKENLEYMSKLAVEESGMGAYEYKVIKNRLAAVKSPGVEDLTTEALSGDDGLTLVEYCPFGVIGAIAPTTNPTETVICNSIAMLAGGNTVVFSPHPRSKGVSIWLIKKLNAKLEELGAPRNLIVTVKEPSIENTNIMMNHPKVRMLVATGGPGIVKAVMSTGKKAIGAGAGNPPVVVDETADIEKAAKDIVNGCSFDNNLPCIAEKEVIAVDQIADYLIFNMKNNGAYEVKDPEIIEKMVDLVTKDRKKPAVNFVGKSAQYILDKVGIKVGPEVKCIIMEAPKDHPFVQIELMMPILPIVRVPNVDEAIDFAVEVEHGNRHTAMMHSKNVDKLTKMAKEIETTIFVKNGPSYAGIGVGGMGYTTFTIAGPTGEGLTSAKSFCRKRRCVLQDGLHIRMK

SEQ ID NO: 508 - protein, 467 aa, Halanaerobium saccharolyticum
MKIKENELDKIVNQVISSLNNKQNSNDFNTKINYGIFSTMDEAIAEAVKAQACLQLNYSTEAREKIIKSIRKNVSKHVEKISEMAVEETDMGRIEDKIIKNNLAINKTPGTEDLRTEAFSGKKGLTIVEEAPFGVICSIAPVTNPTETIISNAISMIASCNGVVFNSHPGAKKVSKYIIEVLNKVIMEAGGPENLLTAVNEPTLQTVESCMRDDRIAMIVATGGPGVVNAALSSGKKAIGAGAGNPPVLVDDTVDLKRVAKDIINGASFDNNLPCTSEKAIVALESIADSLLNEMTNQNAQLVHDIKALERVILNDDGSINKALVGKDAAFILNKAGLKAKSEDLRLVIVDVDLRHPFVQKEQLMPVIPLVRAKNFNEAMEMGVDIEEGNRHTAIIHSKNVDNLTKFAKKIETTIYVKNAPSYAGIGAGGEGYATFTIAGPTGEGLTSARSFTRKRRCVLVDGFSII

SEQ ID NO: 509 - protein, 469 aa, Eubacterium limosum
MNIDTTGIEYIVKKVMDQIDYAEETGAPVVDGKDGVFQTMDAAIEAAAVAQKEYMKKPLALRRQMIAAMREIMLKKENIETICAMVVEESGMGNYEHKLAKHRLATTGTPGVEDLLTEAWAGDDGCTLLELSPFGVIGAITPTTNPNETIVNNSIGMLAAGNAVVFSPHPKALKTSFLCIKLLNEAIVSVGGPRNLIVTCANPTIEAANEMMVHPKIRMLVATGGPGVVKAVLSSGKKAIGAGAGNPPALVDETADIEKAAKDIIDGCSFDNNLPCIAEKEVVVVDQVADYLIFNMKKNGAYEITDKKAIDALADLVCPEGRLSRDFVGKSAKYIAAAAGLDVPEDTRVLICETSKDHLLAVEELMMPILPIVRVANVDEGIDVAVELEHGNRHTAIMHSKNVDKLTEMAKRIQTTIFVKNGPSYAGIGFGGEGYPTFTIAGPTGEGLTSAKSFARRRRCVLVGGFDIK

SEQ ID NO: 510 - protein, 466 aa, Thermoanaerobacter sp.
MIDENLVVTITKKILNEINLKEAEEKKEKDNPDLGIFNDVNEAVECAKEAQKKFALMDLEKREEIIAAIREACVNNARLLAEIACSETGRGRVEDKVAKNILAAKKTPGTEDLKPTAWTGDRGLTLVEMAPVGVIASITPVTNPTATIINNTISMLAAGNAVVFNPHPSAKKTSNKAVEIINEAILKVGAPNGLVCSINNPTIQTAQKLMEHPEVNMVVVTGGKAVVQTALRCGKKVIGAGAGNPPVVVDETADIVKAAHDIACGASFDNNLPCIAEKEIIAVERIADTLLERMKREGAYVLHGKDIDRMTELIFQGGAINKDLIGRDAHFILSQIGIETGKDIRLVVMPVDVSHPLVYHEQLMPVIPFVTVPTVEEAINLAVKAEGGNRHTAMMHSKNVENMTAFARAIQTTIFVKNAPSYAGIGFGGEGYTTFTIAGPTGEGLTSARTFTRQRRCVLVDAFRIV

SEQ ID NO: 511 - protein, 529 aa, Rhodospirillum rubrum
MNDGQIAAAVAKVLEAYGVPADPSAAAPAPAAPVAPAAPTAGSVSEMIARGIAKASSDDQIAQIVAKVVGDYSAQAAKPAVVPGAAASTEAGDGVFDTMDAAVDAAVLAQQQYLLCSMTDRQRFVDGIREVILQKDTLELISRMAAEETGMGNYEHKLIKNRLAAEKTPGTEDLTTEAFSGDDGLTLVEYSPFGAIGAVAPTTNPTETIICNSIGMLAAGNSVIFSPHPRATKVSLLTVKLINQKLACLGAPANLVVTVSKPSVENTNAMMAHPKIRMLVATGGPGIVKAVMSTGKKAIGAGAGNPPVVVDETADIEKAALDIINGCSFDNNLPCIAEKEIIAVAQIADYLIFSMKKQGAYQITDPAVLRKLQDLVLTAKGGPQTSCVGKSAVWLLNKIGIEVDSSVKVILMEVPKEHPFVQEELMMPILPLVRVSDVDEAIAVAIEVEHGNRHTAIMHSTNVRKLTKMAKLIQTTIFVKNGPSYAGLGVGGEGYTTFTIAGPTGEGLTSAKSFARKRKCVMVEALNIR

SEQ ID NO: 512 - protein, 466 aa, Eubacterium yurii
MNPELLEDVVRQVLSEMKLESSKMVDIYNYGIFDSVDDAINASEIAQRQLFECSVQKRNEYVNAIRQIILKKDNLEMMSRDAVEETGIGRYEDKILKNKLAAEKTPGMEDLITRAVSGQDGLTLEEYCPFGVIGSITPTTNPTETFISNSISMIVGGNTVVFSPHPRAKNTSIKLVKLMNKALEQVGAPRNLISMVKEPSIENTNLMMNHPKIKMLVATGGPAIVKTVLSSGKKAIGAGAGNPPVVVDETADIEKAAKDIVAGSSFDNNVPCIAEKEVFAVESICDQLIYHMKKNGAYEITSYEMIEKLDKLVSQENGKPNTDFVGKSAKYILEKLGISVDDSIRLIICRTNKDHHLVQEEMLMPILPIVSVSDVDVAIEYAYEAEHRNRHTAIMHSRNVEKLSKMAKKLEATIFVKNAPSYAGIGVGGEGYTTFTIAGPTGEGLTSPKSFCRVRRCTMSDSFSIR

SEQ ID NO: 513 - protein, 466 aa, Eubacterium sp.
MNPELLEDVVRQVLSEMKLESSKMVDIYNYGIFDSVDDAINASEIAQRQLFECSVQKRNEYVNAIRQIILKKDNLEMMSRDAVEETGIGRYEDKILKNKLAAEKTPGMEDLITRAVSGQDGLTLEEYCPFGVIGSITPTTNPTETFISNSISMIVGGNTVVFSPHPRAKNTSIKLVKLMNKALEQVGAPRNLISMVKEPSIENTNLMMNHPKIKMLVATGGPAIVKTVLSSGKKAIGAGAGNPPVVVDETADIEKAAKDIVAGSSFDNNVPCIAEKEVFAVESICDQLIYHMKKNGAYEITSYEMIEKLDKLVSQENGKPNTDFVGKSAKYILEKLGINVDDSIRLIICRTNKDHHLVQEEMLMPILPIVSVSDVDVAIEYAYEAEHRNRHTAIMHSRNVEKLSKMAKKLEATIFVKNAPSYAGIGVGGEGYTTFTIAGPTGEGLTSPKSFCRVRRCTMSDSFSIR

SEQ ID NO: 514 - protein, 532 aa, Vibrio sp.
MNEQEIAHAVENVLSKYTNVTAQNAEPVSYSSNASLENIVSQALAGNMVKQPETQTAPDLNSNIENIVSQILAENQAKPQSVQCQSANHGTTEYLGCFASMEEAISAASHAQVQYRHCTMGDRASFVKGIREVFTQDDVLEKISRMAVEETGMGNYADKLTKNRIAATKTPGIEDLTTSALSGDSGLTLTEFSAYGVIGSITPTTNPTETIINNSIGMLAAGNTVVYSPHPRSRNVSLVAVDLINRKLAELGAPANLVVTVLEPSIDNTNAMMNDPRVNMLVATGGPSIVKTVMSTGKKAIGAGAGNPPAVVDETANIEKAAKDIINGCAFDNNLPCIAEKEVIVVNEVADYLIHCMKKSGAYLLCDKQKIQQLQSLVLNEKGTGPNTSFVGKGARYILDKLNIQVSDDIKVILIETERNHPFVVHELMMPILPVVRVENVDEAIDLAIKVEHGNRHTAIMHSTNVEKLSKMARLIQTTIFVKNGPSYSGIGVGGEGHTTFTIAGPTGEGITSARSFARYRRCVMVEALNIR

SEQ ID NO: 515 - protein, 467 aa, Eubacteriaceae bacterium
MNAELLQDVVRQVLSEMKLESSNILSNEYNYGIFDDMEAAINASETAQRKLFECSVQQRNEFANVIRKEILKKDNLEMISRDAVEETEIGRFEDKILKNKVAAEKTPGMEDLTTRAISGKDGLMIEEYCPFGVIGSITPTTNPTETLINNSISMIVGGNTVVFSPHPRAKNVSIKLVKMMNKALEEHGAPRNMITMVKEPSIENTNLMMSNPKVKLLVATGGPFIVNTVLSSGKKAIGAGAGNPPVVVDETADIEKAAIDIVSGASFDNNVPCIAEKEVFAVDSISDMLIYHMKKNGAYEIVSQDMIEKLDKLVSQENGKPKTEFVGKSAKYILEKLGIYVDDSIRLIICRTSKNHHLVQEEMLMPILPIVSVSDVDIAIEYAYEAEHGNRHTAIMHSKNVEKLSKMAKKLEATIFVKNAPSYSGIGVGGEGHTTFTIAGPTGEGITSAKSFCRIRRCVMHDSFSIR

SEQ ID NO: 516 - protein, 473 aa, Propionibacterium propionicum
MKIDPAQLEATIREVLAAMLPGNDNQTEAPATQQEAPGDGVFADMDSAVEAAHLAQREYLSHPMADRRRYVAAIREAMLAPEALDYMSEQAVAQSGMGDVGHKYLKNKVAAAETPGVEDLVTEAWSGDDGLTTIEYSPYGVIGAITPTTNPTETITCNSIGMLAAGNAVVFSPHPRVAKLSCWQVRRINRALRAAGAPDNLVVTVTAPSLENTNAMMAHPKVRMLVATGGPGIVKAVLSSGKKAIGAGAGNPPAVVDETADIEHAAKCIVDGASFDNNLPCTAEKEIIAVDSIADMLKFCMIKHGAYEATASEVAELEKLLVNGDKPRTEWVGKPAAKILEAIGVTPPPGVRLIVCEASATHPFVVHELMMPVLGLVRVPDVDAAIDLAVELEHGNRHTAVMHSLNVSKLTKMGKLIQTTIFVKNGPSYNGIGIGGEGYPTFTIAGPTGEGLTSARSFTRKRRCVLVGDLNVR

SEQ ID NO: 517 - protein, 467 aa, Eubacteriaceae bacterium
MNAELLQDVVRQVLSEMKLESSNILSNEYNYGIFDDMEAAINASETAQRKLFECSVQQRNEFANVIRKEILKKDNLEMISRDAVEETEIGRFEDKILKNKVAAEKTPGMEDLTTRALTGKDGLMIEEYCPFGVIGSITPTTNPTETLINNSISMIVGGNTVVFSPHPRAKNVSIKLVKMMNKALEEYGAPRNMITMVKEPSIENTNLMMSNPKVKLLVATGGPFIVNTVLSSGKKAIGAGAGNPPVVVDETADIEKAAIDIVSGASFDNNVPCIAEKEVFAVDSISDMLIYHMKKNGAYEIVSQDMIEKLDKLVSQENGKPKTEFVGKSAKYILEKLGIYVDDSIRLIICRTSKNHHLVQEEMLMPILPIVSVSDVDIAIEYAYEAEHGNRHTAIMHSKNVEKLSKMAKKLEATIFVKNAPSYSGIGVGGEGHTTFTIAGPTGEGITSAKSFCRIRRCVMHDSFSIR

SEQ ID NO: 518 - protein, 467 aa, Eubacteriaceae bacterium
MNAELLQDVVRQVLSEMKLESSNILSNEYNYGIFDDMEAAINASETAQRKLFECSVQQRNEFANVIRREVLKKDNLEMISRDAVEETEIGRFEDKILKNKVAAEKTPGMEDLTTRALTGKDGLMIEEYCPFGVIGSITPTTNPTETLINNSISMIVGGNTVVFSPHPRAKNVSIKLVKMMNKALEEYGAPRNMITMVKEPSIENTNLMMSNPKVKLLVATGGPFIVNTVLSSGKKAIGAGAGNPPVVVDETADIEKAAIDIVSGASFDNNVPCIAEKEVFAVDSISDMLIYHMKKNGAYEIVSQDMIEKLDKLVSQENGKPKTEFVGKSAKYILEKLGIYVDDSIRLIICRTSKNHHLVQEEMLMPILPIVSVSDVDIAIEYAYEAEHGNRHTAIMHSKNVEKLSKMAKKLEATIFVKNAPSYSGIGVGGEGHTTFTIAGPTGEGITSAKSFCRIRRCVMHDSFSIR

SEQ ID NO: 519 - DNA, 5097 bp, Artificial Sequence
  Description of Artificial Sequence: Synthetic polynucleotide
tgtgagtgaaagtcacctgccttaatatctcaaaactcatcttcgggtgacgaaatatggcgtgactcgatacttcactccgcaatgcattccttgatgaattcgcaggaccgtgatacacgggacaggtcactgaatgacgacaatgtcctggaaatcagcgaaccgcgcatctgaagtacatttgagcgactgtaccagaacatgaatgaggcgtttggattaggcgattattagcagggctaagcattttactattattattttccggttgagggatatagagctatcgacaacaaccggaaaaagtttacgtctatattgctgaaggtacaggcgtttccataactatttgctcgcgttttttactcaagaagaaaatgccaaatagcaacatcaggcagacaatacccgaaattgcgaagaaaactgtctggtagcctgcgtggtcaaagagtatcccagtcggcgttgaaagcagcacaatcccaagcgaactggcaatttgaaaaccaatcagaaagatcgtcgacgacaggcgcttatcaaagtttgccacgctgtatttgaagacggatatgacacaaagtggaacctcaatggcatgtaacaacttcactaatgaaataatccaggggttaacgaacagcgcgcaggaaaggatacgcaacgccataatcacaactccgataagtaatgcattttttggccctacccgattcacaaagaaaggaataatcgccatgcacagcgcttcgagtaccacctggaatgagttgagataaccatacaggcgcgttcctacatcgtgtgattcgaataaacctgaataaaagacaggaaaaagttgttgatcaaaaatgttatagaaagaccacgtccccacaataaatatgacgaaaacccagaagtttcgatccttgaaaactgcgataaaatcctctttttttacccctcccgcatctgccgctacgcactggtgatccttatctttaaaacgcatgttgatcatcataaatacagcgccaaatagcgagaccaaccagaagttgatatggggactgatactaaaaaatatgccggcaaagaacgcgccaatagcatagccaaaagatccccaggcgcgcgctgttccatattcgaaatgaaaatttcgcgccattttttcggtgaagctatcaagcaaaccgcatcccgccagataccccaagccaaaaaatagcgcccccagaattagacctacagaaaaattgctttgcagtaacggttcataaacgtaaatcataaacggtccggtcaagaccaggatgaaactcatacaccagatgagcggtttcttcagaccgagtttatcctgaacgatgccgtagaacatcataaatagaatgctggtaaactggttgaccgaataaagtgtacctaattccgtccctgtcaaccctagatgtcctttcagccaaatagcgtataacgaccaccacagcgaccaggaaataaaaaagagaaatgagtaactggatgcaaaacgatagtacgcatttctgaatggaatattcagtgccataattacctgcctgtcgttaaaaaattcacgtcctatttagagataagagcgacttcgccgtttacttctcactattccagttcttgtcgacatggcagcgctgtcattgcccctttcgccgttactgcaagcgctccgcaacgttgagcgagatcgataattcgtcgcatttctctctcatctgtagataatcccgtagaggacagacctgtgagtaacccggcaacgaacgcatctcccgcccccgtgctatcgacacaattcacagacattccagcaaaatggtgaacttgtcctcgataacagaccaccaccccttctgcacctttagtcaccaacagcatggcgatctcatactcttttgccagggcgcatatatcctgatcgttctgtgtttttccactgataagtcgccattcttcttccgagagcttgacgacatccgccagttgtagcgcctgccgcaaacacaagcggagcaaatgctcgtcttgccatagatcttcacgaatattaggatcgaagctgacaaaacctccggcatgccggatcgccgtcatcgcagtaaatgcgctggtacgcgaaggctcggcagacaacgcaattgaacagagatgtaaccattcgccatgtcgccagcagggcaagtctgtcgtctctaaaaaaagatcggcactggggcggaccataaacgtaaatgaacgttccccttgatcgttcagatcgacaagcaccgtggatgtccggtgccattcatcttgcttcagatacgtgatatcgactccctcagttagcagcgttctttgcattaacgcaccaaaaggatcatcccccacccgacctataaacccacttgttccgcctaatctggcgattcccaccgcaacgttagctggcgcgccgccaggacaaggcagtaggcgcccgtctgattctggcaagagatctacgaccgcatcccctaaaacccatactttggctgacatttttttcccttaaattcatctgagttacgcatagtgataaacctctttttcgcaaaatcgtcatggatttactaaaacatgcatattcgatcacaaaacgtcatagttaacgttaacatttgtgatattcatcgcatttatgaaagtaagggactttatttttataaaagttaacgttaacaattcaccaaatttgcttaaccaggatgattaaaatgacgcaatctcgattgcatgcggcgcaaaacgccctagcaaaacttcatgagcaccggggtaacactttctatccccattttcacctcgcgcctcctgccgggtggatgaacgatccaaacggcctgatctggtttaacgatcgttatcacgcgttttatcaacatcatccgatgagcgaacactgggggccaatgcactggggacatgccaccagcgacgatatgatccactggcagcatgagcctattgcgctagcgccaggagacgataatgacaaagacgggtgtttttcaggtagtgctgtcgatgacaatggtgtcctctcacttatctacaccggacacgtctggctcgatggtgcaggtaatgacgatgcaattcgcgaagtacaatgtctggctaccagtcgggatggtattcatttcgagaaacagggtgtgatcctcactccaccagaaggaatcatgcacttccgcgatcctaaagtgtggcgtgaagccgacacatggtggatggtagtcggggcgaaagatccaggcaacacggggcagatcctgctttatcgcggcagttcgttgcgtgaatggaccttcgatcgcgtactggcccacgctgatgcgggtgaaagctatatgtgggaatgtccggactttttcagccttggcgatcagcattatctgatgttttccccgcagggaatgaatgccgagggatacagttaccgaaatcgctttcaaagtggcgtaatacccggaatgtggtcgccaggacgactttttgcacaatccgggcattttactgaacttgataacgggcatgacttttatgcaccacaaagctttttagcgaaggatggtcggcgtattgttatcggctggatggatatgtgggaatcgccaatgccctcaaaacgtgaaggatgggcaggctgcatgacgctggcgcgcgagctatcagagagcaatggcaaacttctacaacgcccggtacacgaagctgagtcgttacgccagcagcatcaatctgtctctccccgcacaatcagcaataaatatgttttgcaggaaaacgcgcaagcagttgagattcagttgcagtgggcgctgaagaacagtgatgccgaacattacggattacagctcggcactggaatgcggctgtatattgataaccaatctgagcgacttgttttgtggcggtattacccacacgagaatttagacggctaccgtagtattcccctcccgcagcgtgacacgctcgccctaaggatatttatcgatacatcatccgtggaagtatttattaacgacggggaagcggtgatgagtagtcgaatctatccgcagccagaagaacgggaactgtcgctttatgcctcccacggagtggctgtgctgcaacatggagcactctggctactgggttaacataatatcaggtggaacaacggatcaacagcgggcaagggatccgcgtcactcttcccccttcacgaccttcaataatatgcaatgcagcttcccgcccgataatgtcatgtggaagctgaattgtggtcagcggcggtaaaaacagatgcccgacgccaaccagattatcaaagcccattacggcgacatcctgcgggattcgtacccccttcgccagaagaacctgataagccacaaaggctgcgcgatcgttaccacatatcagaacatcaaaatctggtttgcccggtttgaagtgggcattgagtaaacttgcgagatcggtgtagtgatcatcacctgttgccatgtgaaattgtttcacctcagccagatctcgtccagcatcacgccaggcctgctcaaatccctgccgacgataccctgttgccaacgcactttccggtagccagaagcataacggttgacgatagcccgccgcgagcaaatgctgtgttgattcatattgtgcagtgtaatcatcagggatataactgggtaacgctgggtcatccgccacacagttcgccaatacaatattttcaccatacagagactcaggcagcgtgatatgtcgcagccccattgtagtatagataatgccatccggacggtgggcaagcagctgacgtgccgcgcgggcagcgtcatcttcagaaaaaatattgattaaaaaactattccagccgaactcgctggcggtttgctcaatggcaagcagaatatcaacagagaaaggagtggtagccgtgtcctgcgccagcacggcgagagtcgacggcttacgtccttgagcgcgcatcttaacgccgaagctgttttggcggatgagagaagattttcagcctgatacaga

What is claimed is:

1. An isolated nucleic acid molecule selected from:
   (a) a nucleic acid molecule encoding a variant amino acid sequence of a parent polypeptide set forth in any one of: SEQ ID NOS: 439-518, wherein said variant amino acid sequence comprises two or more variant amino acid positions selected from a group consisting of: 12L, 15P, 34K, 42D, 44L, 47T, 51R, 51K, 56G, 57A, 58C, 58L, 58H, 59G, 66F, 67S, 67A, 71A, 91R, 104R, 106T, 107V, 127I, 128N, 129A, 129G, 129Y, 129I, 131W, 132A, 133M, 133V, 135P, 136A, 139S, 139T, 142L, 156C, 158V, 159G, 164A, 167P, 172G, 178G, 184M, 187K, 188G, 200M, 204L, 204R, 208A, 208L, 211C, 215M, 215A, 217Q, 226R, 227L, 227I, 229A, 230V, 230R, 230Q, 231I, 233Q, 233V, 234G, 241S, 242S, 242D, 243R, 243N, 243E, 248T, 252S, 253F, 253L, 253V, 253A, 258R, 259T, 260S, 260T, 260C, 265I, 265C, 265W, 265V, 266S, 269L, 273I, 273T, 273S, 273M, 273N, 279T, 280S, 281L, 284P, 288L, 289K, 291V, 294V, 295F, 298L, 310L, 310P, 317A, 317T, 327K, 333A, 349W, 360E, 370L, 370H, 395P, 396H, 396K, 396W, 396V, 398F, 401M, 406H, 411W, 416G, 416S, 417A, 419S, 426G, 427L, 427F, 427V, 429L, 429M, 437P, 439H, 441S, 446V, 446I, 447P, 456A, 464T, 464S, 466N, 468N, 47V, 113N, 177Y, 193L, 260V, 294D, 353N, 355A, 383Y, 13L, 16P, 32K, 40D, 42L, 45T, 45V, 49R, 49K, 54G, 55A, 56C, 56L, 56H, 57G, 64F, 65S, 65A, 69A, 89R, 102R, 104T, 105V, 111N, 125I, 126N, 127A, 127G, 127Y, 129W, 130A, 131M, 131V, 133P, 134A, 137S, 137T, 140L, 154C, 156V, 157G, 162A, 165P, 170G, 175Y, 176G, 182M, 185K, 186G, 191L, 198M, 202L, 202R, 206A, 206L, 209C, 213M, 213A, 215Q, 224R, 225I, 227A, 228V, 228R, 228Q, 229I, 231Q, 231V, 232G, 239S, 240S, 240D, 241R, 241N, 241E, 246T, 250S, 251F, 251L, 251V, 251A, 256R, 257T, 258S, 258T, 263I, 263C, 263W, 263V, 264S, 267L, 271I, 271T, 271S, 271M, 271N, 277T, 278S, 279L, 282P, 286L, 287K, 289V, 292V, 292D, 293F, 296L, 308L, 308P, 316A, 316T, 326K, 332A, 348W, 352N, 354A, 359E, 369L, 369H, 382Y, 394P, 395H, 395K, 395W, 395V, 397F, 400M, 405H, 133R, 146R, 148T, 149V, 155N, 170N, 171A, 171G, 171Y, 171I, 173W, 174A, 175M, 175V, 177P, 178A, 181S, 181T, 184L, 198C, 200V, 201G, 209P, 214G, 219Y, 220G, 226M, 229K, 230G, 235L, 242M, 246R, 250A, 250L, 253C, 257M, 257A, 259Q, 268R, 269I, 271A, 272V, 272R, 272Q, 275Q, 275V, 276G, 283S, 284S, 284D, 285R, 285N, 285E, 290T, 294S, 295L, 295V, 295A, 300R, 301T, 302S, 302T, 302C, 302V, 307I, 307C, 307W, 307V, 308S, 311L, 315I, 315T, 315S, 315M, 315N, 321T, 322S, 323L, 326P, 330L, 331K, 333V, 336V, 336D, 337F, 340L, 352L, 352P, 359A, 359T, 379K, 385A, 401, 405N, 407A, 412E, 55C, 55H, 55L, 63F, 64S, 64A, 68A, 88R, 101R, 103T, 104V, 110N, 124I, 125N, 126A, 126G, 126Y, 126I, 128W, 130M, 130V, 132P, 133A, 136S, 136T, 139L, 153C, 155V, 156G, 160A, 169G, 174Y, 175G, 181M, 184K, 185G, 190L, 197M, 201L, 201R, 205A, 205L, 208C, 212M, 212A, 214Q, 223R, 224L, 224I, 226A, 227V, 227R, 227Q, 228I, 231G, 238S, 239D, 240R, 240N, 240E, 245T, 248S, 250F, 250V, 255R, 256T, 257S, 257C, 257V, 262I, 262C, 262W, 262V, 263S, 266L, 270I, 270T, 270S, 270M, 270N, 276T, 277S, 278L, 281P, 285L, 286K, 288V, 291D, 292F, 314A, 334K, 340A, 357W, 360N, 362A, 367E, 377L, 377H, 388Y, 402P, 403H, 403K, 403W, 403V, 405F, and 408M; wherein the variant amino acid sequence can convert 4-hydroxybutyryl-CoA (4HB-CoA) to 4-hydroxybutyraldehyde (4-HBAld); and
(b) a nucleic acid molecule that is complementary to the nucleic acid molecule of (a);
wherein other than the two or more variant amino acid positions, the variant amino acid sequence has at least 90% sequence identity to any one of the parent polypeptide amino acid sequences of SEQ ID NOS: 439-518; and
wherein the variant amino acid sequence is not the sequence of the parent polypeptide or a naturally occurring amino acid sequence.

2. The isolated nucleic acid molecule of claim 1, wherein other than the two or more variant amino acid positions said variant amino acid sequence has at least 95%, 98% or 99% sequence identity, or is identical, to any one of the parent polypeptide amino acid sequences of SEQ ID NOS: 439-518.

3. The isolated nucleic acid molecule of claim 1, wherein said variant amino acid sequence comprises at least three, four, five, six, seven, eight, nine, ten, eleven, twelve, thirteen, fourteen, fifteen, sixteen, seventeen, eighteen, nineteen, twenty or more variant amino acid positions set forth in SEQ ID NOS: 241-247.

4. A vector containing the nucleic acid molecule of claim 1.

5. The vector of claim 4, wherein said vector is an expression vector.

6. A host cell comprising the vector of claim 4.

7. A host cell comprising the nucleic acid of claim 1.

8. The host cell of claim 7, wherein said nucleic acid molecule is integrated into a host chromosome.

9. The host cell of claim 8, wherein said integration is site-specific.

10. The host cell of claim 6, wherein said host cell is a non-naturally occurring microbial organism having a pathway that produces 4-hydroxybutanoate, 4-hydroxybutyrate (4-HB), gamma-butyrylactone (GBL), 4-hydroxybutyraldehyde (4-HBal), 4-hydroxybutyryl-CoA (4-HBCoA), gamma (γ)-butyrolactone, 1,4-butanediol (BDO) and/or putrescine.

11. The host cell of claim 6, wherein said nucleic acid molecule is expressed.

12. The host cell of claim 6, wherein said host cell is capable of fermentation.

13. Culture medium comprising the host cell of claim 6.

14. A method for producing 4-hydroxybutyrate (4-HB), gamma-butyrolactone (GBL), 4-hydroxybutyraldehyde (4-HBal), 4-hydroxybutyryl-CoA (4-HBCoA), 1,4-butanediol (BDO) and/or putrescine comprising culturing said host cell of claim 6 under conditions and for a sufficient period of time to produce 4-HB, GBL, 4-HBal, 4-HBCoA, BDO and/or putrescine.

15. A method for producing 4-HB, GBL, 4-HBal, 4-HB-CoA, BDO, and/or putrescine comprising culturing a non-naturally occurring microbial organism having a pathway that produces 4-HB, GBL, 4-HBal, 4-HBCoA, BDO, and/or putrescine under conditions and for a sufficient period of time to produce 4-HB, GBL, 4-HBal, 4-HBCoA, BDO, and/or putrescine, wherein said non-naturally occurring microbial organism comprises the nucleic acid molecule of claim 1.

16. The method of claim 14, wherein said host cell is in a substantially anaerobic culture medium.

17. The method of claim 15, wherein said non-naturally occurring microbial organism is in a substantially anaerobic culture medium.

* * * * *